US012698510B2

(12) United States Patent
Kretzmann et al.

(10) Patent No.: US 12,698,510 B2
(45) Date of Patent: Aug. 4, 2026

(54) DNA ORIGAMI ENCODING FOR GENE EXPRESSION AND CONTRANSFECTION

(71) Applicant: Technische Universität München, Munich (DE)

(72) Inventors: Jessica Kretzmann, Manning (AU); Hendrik Dietz, Haar (DE)

(73) Assignee: Technische Universität München, Munich (DE)

( * ) Notice: Subject to any disclaimer, the term of this patent is extended or adjusted under 35 U.S.C. 154(b) by 0 days.

(21) Appl. No.: 19/193,742

(22) Filed: Apr. 29, 2025

(65) Prior Publication Data

US 2025/0257366 A1     Aug. 14, 2025

Related U.S. Application Data

(63) Continuation of application No. PCT/EP2023/081932, filed on Nov. 15, 2023.

(30) Foreign Application Priority Data

Nov. 15, 2022     (EP) .................................... 22207474

(51) Int. Cl.
　　*C12N 15/85* 　　　　(2006.01)
　　*C12N 15/87* 　　　　(2006.01)

(52) U.S. Cl.
　　CPC ............. *C12N 15/85* (2013.01); *C12N 15/87* (2013.01); *C12N 2310/531* (2013.01); *C12N 2830/42* (2013.01); *C12N 2830/48* (2013.01); *C12N 2830/50* (2013.01)

(58) Field of Classification Search
None
See application file for complete search history.

(56) References Cited

U.S. PATENT DOCUMENTS

| 2022/0184231 A1 | 6/2022 | Klatte |
| 2022/0220488 A1 | 7/2022 | Alkan |
| 2023/0323404 A1 | 10/2023 | Doudna et al. |

FOREIGN PATENT DOCUMENTS

| WO | 2022064202 A1 | 3/2022 |
| WO | 2022068884 A1 | 4/2022 |

OTHER PUBLICATIONS

Acevedo, J.M., Hoermann, B., Schlimbach, T. & Teleman, A. A. Changes in global translation elongation or initiation rates shape the proteome via the Kozak sequence. Sci Rep 8 , 4018 (2018).
Bastings, M. M. C. et al. Modulation of the Cellular Uptake of DNA Origami through Control over Mass and Shape. Nano Lett. 18, 3557-3564 (2018).
Brun, S., Faucon-Biguet, N. & Mallet, J. Optimization of transgene expression at the posttranscriptional level in neural cells: implications for gene therapy. Molecular Therapy 7, 782-789 (2003).
Cao, L., During, M. & Xiao, W. Replication competent helper functions for recombinant MV vector generation. Gene Ther 9 , 1199-1206 (2002).
Dean, D. A., Dean, B. S., Muller, S. & Smith, L. C. Sequence Requirements for Plasmid Nuclear Import. Experimental Cell Research 253, 713-722 (1999).
Engelhardt, F. A. S. et al. Custom-Size, Functional, and Durable DNA Origami with Design-Specific Scaffolds. ACS Nano 13, 5015-5027 (2019).
European Search Report dated May 5, 2023 issued in European patent application No. 22207474.2.
Gerling, T., Kube, M., Kick, B. & Dietz, H. Sequence-programmable covalent bonding of designed DNA assemblies. Science Advances (2018).
Gerling, T., Wagenbauer, K. F., Neuner, A. M. & Dietz, H. Dynamic DNA devices and assemblies formed by shape-complementary, non-base pairing 3D components. Science 347, 1446-1452 (2015).
International Search Report and Written Opinion dated Feb. 28, 2024 issued in international patent application No. PCT/EP2023/081932.
Jiang, Y., Ke, C., Mieczkowski, P.A. & Marszalek, P. E. Detecting Ultraviolet Damage in Single DNA Molecules by Atomic Force Microscopy. Biophys J 93, 1758-1767 (2007).
Kremer, J. R., Mastronarde, D. N. & McIntosh, J. R. Computer Visualization of ThreeDimensional Image Data Using IMOD. Journal of Structural Biology 116, 71-76 (1996).
Kretzmann JA, Liedl A, Monferrer A, Mykhailiuk V, Beerkens S, Dietz H. Gene-encoding DNA origami for mammalian cell expression. Nat Commun. Feb. 23, 2023;14(1):1017.
Liedl A, Grießing J, Kretzmann JA, Dietz H. Active Nuclear Import of Mammalian Cell-Expressible DNA Origami. J Am Chem Soc. Mar. 8, 2023;145(9):4946-4950.
Lin-Shiao E et al., CRISPR-Cas9-mediated nuclear transport and genomic integration of nanostructured genes in human primary cells, Nucleic Acids Res. Feb. 22, 2022;50(3):1256-1268.
Mitchell, D. L., Vaughan, J.E. & Nairn, R. S. Inhibition of transient gene expression in Chinese hamster ovary cells by cyclobutane dimers and (6-4) photoproducts in transfected ultraviolet-irradiated plasmid DNA. Plasmid 21, 21-30 (1988).

(Continued)

*Primary Examiner* — Nancy J Leith
(74) *Attorney, Agent, or Firm* — Greenberg Traurig, LLP

(57) ABSTRACT

The present invention relates to a nucleic acid nanostructure comprising at least one scaffold strand and a plurality of staple strands, wherein said nanostructure, preferably said at least one scaffold strand, comprises at least one nucleic acid sequence encoding a gene. The present invention further relates to a composition comprising a nucleic acid nanostructure, and to a collection of nucleic acid sequences or collection of plasmids encoding a nucleic acid nanostructure. Furthermore, the present invention relates to a nucleic acid nanostructure or composition comprising a nucleic acid nanostructure for use in medicine; preferably for use in a method of preventing, treating and/or diagnosing a disease or disorder. The present invention also relates to a method of expressing a gene from a nucleic acid nanostructure, and to a use of a nanostructure or of a composition for gene expression.

13 Claims, 21 Drawing Sheets

Specification includes a Sequence Listing.

(56)     References Cited

OTHER PUBLICATIONS

Ping, H., Liu, X., Zhu, D., Li, T. & Zhang, C. Construction and Gene Expression Analysis of a Single-Stranded DNA Minivector Based on an Inverted Terminal Repeat of AdenaAssociated Virus. Mal Biotechnol 57, 382-390 (2015).

Praetorius, F. et al. Biotechnological mass production of DNA origami. Nature 552, 84-87 (2017).

Rothemund, P. Folding DNA to create nanoscale shapes and patterns. Nature 440, 297-302 (2006). https://doi.org/10.1038/nature04586.

Schindelin, J. et al. Fiji: an open-source platform for biological-image analysis. Nat. Methods 9, 676-682 (2012).

Stahl, E., Martin, T. G., Praetorius, F. & Dietz, H. Facile and Scalable Preparation of Pure and Dense DNA Origami Solutions. Angewandte Chemie 126, 12949-12954 (2014).

Wagenbauer, K. F. et al. How We Make DNA Origami. ChemBioChem 18, 1873-1885 (2017).

Wang, P. et al. Visualization of the Cellular Uptake and Trafficking of DNA Origami Nanostructures in Cancer Cells. J. Am. Chem. Soc. 1-40, 2478-2484 (2018).

Wei, L. & Ploss, A. Hepatitis B virus cccDNA is formed through distinct repair processes of each strand. Nat Commun 12, 1591 (2021).

Xiaohui Wu et al., Genetically Encoded DNA Origami for Gene Therapy In Vivo. Journal of the American Chemical Society 2023 145 (16), 9343-9353.

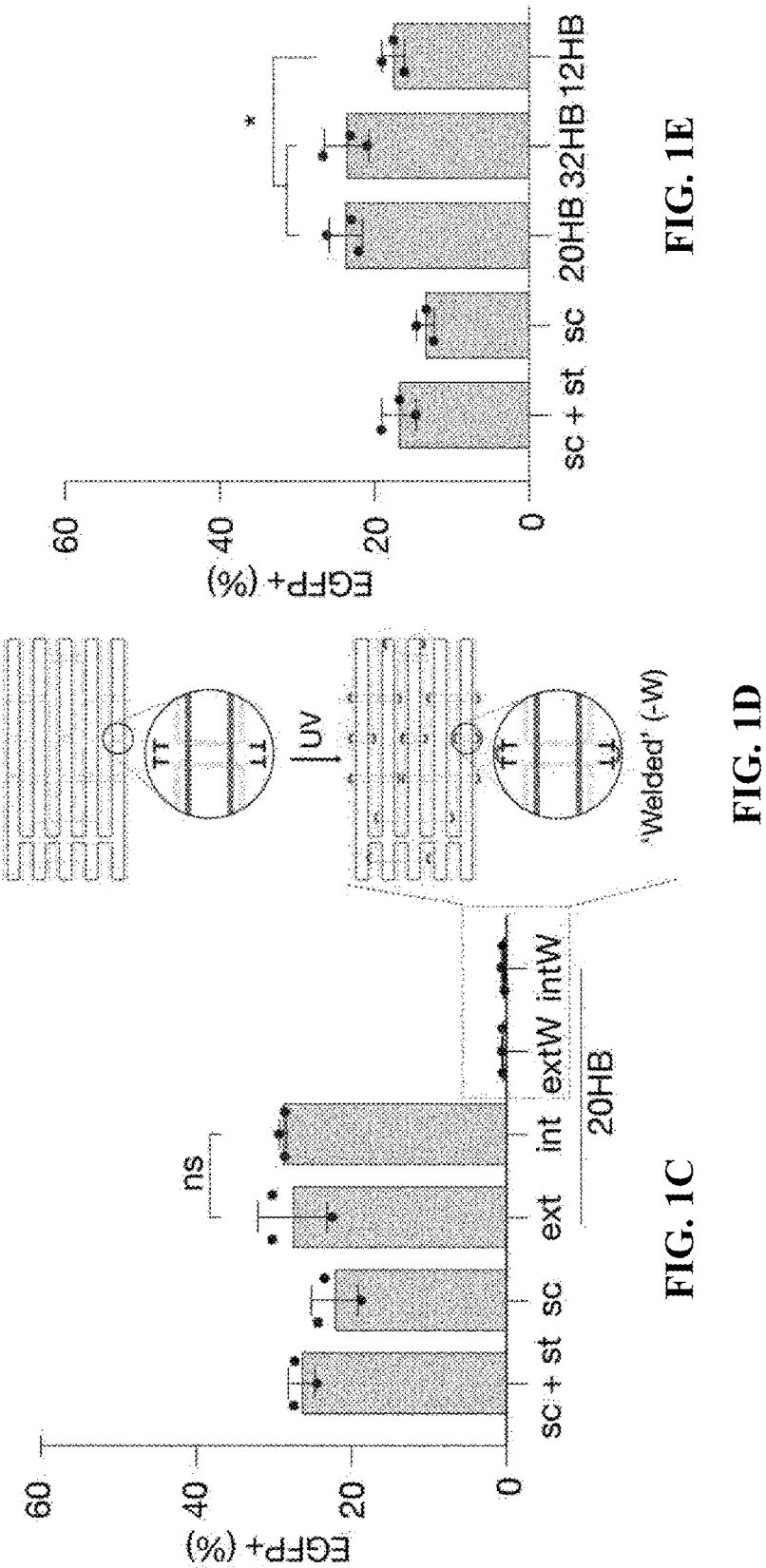

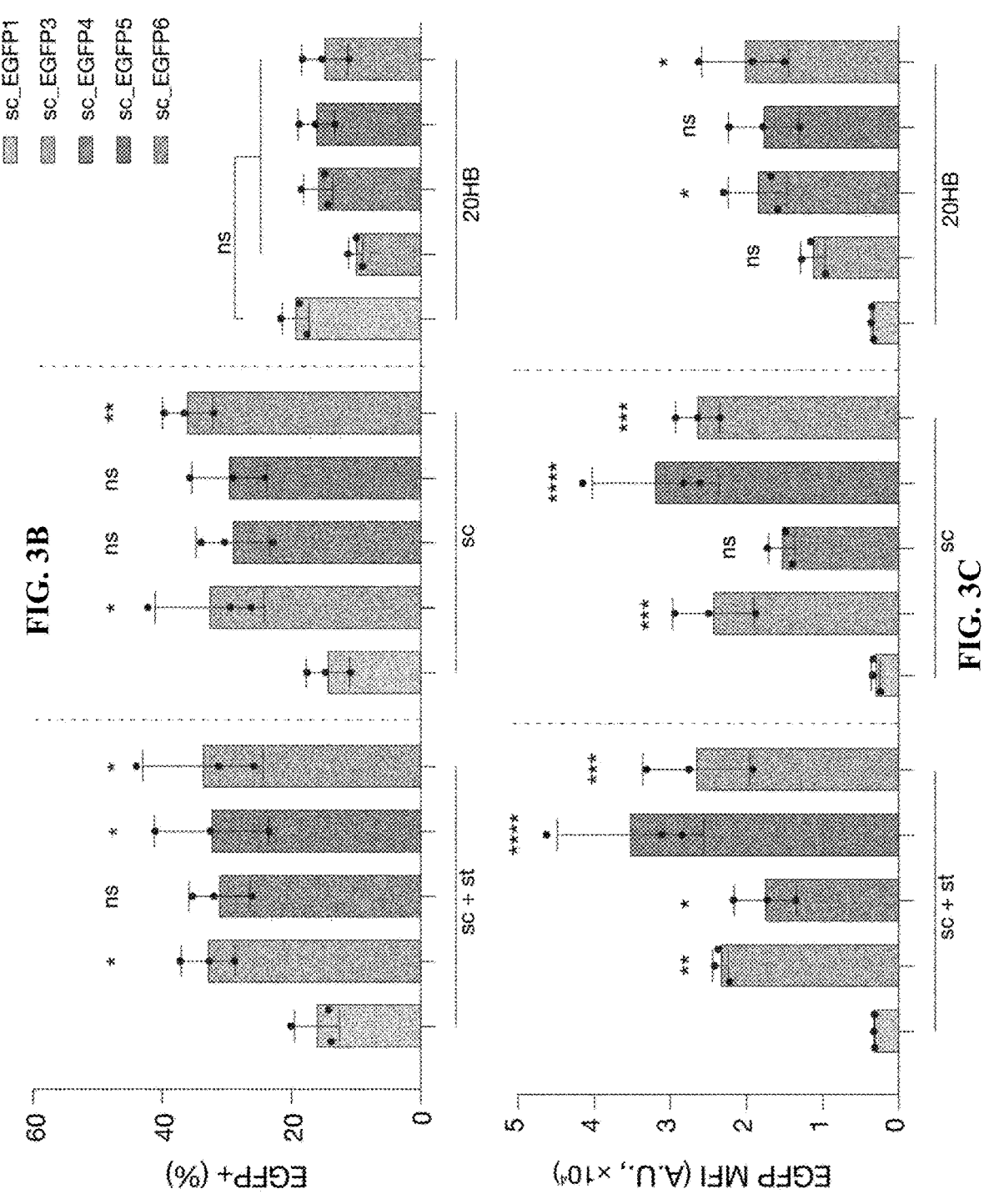

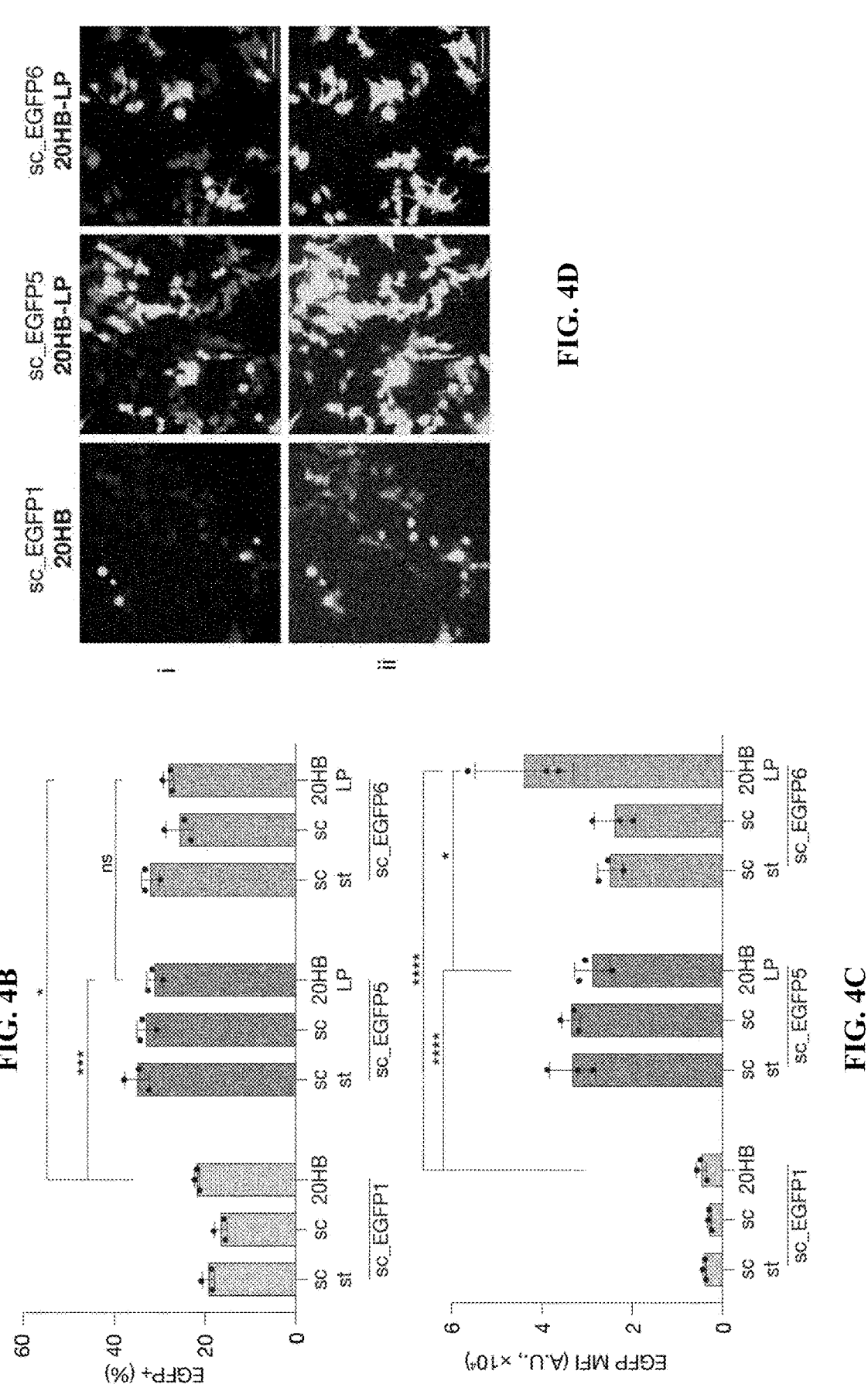

DNA ORIGAMI ENCODING FOR GENE EXPRESSION AND CONTRANSFECTION

RELATED APPLICATIONS

This application is a continuation of International Patent Application No. PCT/EP2023/081932, filed Nov. 15, 2023, and titled DNA ORIGAMI ENCODING FOR GENE EXPRESSION AND COTRANSFECTION, which claims priority to European Patent Application No. 22207474.2, filed Nov. 15, 2022, each of which is incorporated herein by reference in its entirety.

REFERENCE TO A SEQUENCE LISTING

The application contains a Sequence Listing which has been submitted electronically in XML format and is hereby incorporated by reference in its entirety. Said XML copy, created on Apr. 29, 2025, is named P327808US01_Sequence Listing_20250429 and is 2,002,138 bytes in size.

FIELD OF THE INVENTION

The present invention relates to a nucleic acid nanostructure comprising at least one scaffold strand and a plurality of staple strands, wherein said nanostructure, preferably said at least one scaffold strand, comprises at least one nucleic acid sequence encoding a gene. The present invention further relates to a composition comprising a nucleic acid nanostructure, and to a collection of nucleic acid sequences or collection of plasmids encoding a nucleic acid nanostructure. Furthermore, the present invention relates to a nucleic acid nanostructure or composition comprising a nucleic acid nanostructure for use in medicine; preferably for use in a method of preventing, treating and/or diagnosing a disease or disorder. The present invention also relates to a method of expressing a gene from a nucleic acid nanostructure, and to a use of a nanostructure or of a composition for gene expression.

BACKGROUND OF THE INVENTION

Delivering and expressing genes faces a series of obstacles, including how to package, target, and release the nucleic acid to be delivered. These obstacles become further apparent in the delivery of multi-component systems, where precise and tunable amounts of several genes need to be delivered, such as in the case include CRISPR-based technology and construction of gene circuits, for example. Multiplexing to achieve genome or epigenome editing, transcriptional modulation, and/or construction of gene circuits, offers vast potential for tailoring genetic networks for therapeutic (re)programming, bio-production, and basic research. However, despite rapid progress in these fields, simultaneous delivery and expression of multiple genes remains challenging, particularly when looking to deliver in vivo.

Artificial structures formed from nucleic acids, such as DNA origami, have been discussed as having enormous potential for the field of biotechnology. DNA origami enables long single-stranded DNA to be packaged into a compact structure with an unparalleled level of structural programmability and homology, spatial addressability, and biocompatibility. Further, multi-component assemblies of different DNA origami structures can be realized, with structures composed of 220 monomers and reaching over 1 GDa in size. However, while there has been significant progress in the use of DNA origami for applications such as drug delivery, sensing and imaging, there has been limited development of DNA origami for gene therapy. To date, DNA origami has only been utilized as hybrids, with either RNA or proteins, for gene therapeutic studies.

There remains the need for tools for efficiently expressing genes, such as mammalian genes. Particularly, there remains the need for assemblies encoding two or more genes in controlled stoichiometric ratios. Furthermore, there remains the need for simultaneous delivery and expression of one or more genes, e.g. multiple genes. Moreover, there remains the need for tools that efficiently deliver and allow to express genes in vivo.

SUMMARY OF THE INVENTION

In the following, the elements of the invention will be described. These elements are listed with specific embodiments, however, it should be understood that they may be combined in any manner and in any number to create additional embodiments. The variously described examples and preferred embodiments should not be construed to limit the present invention to only the explicitly described embodiments. This description should be understood to support and encompass embodiments which combine two or more of the explicitly described embodiments or which combine the one or more of the explicitly described embodiments with any number of the disclosed and/or preferred elements. Furthermore, any permutations and combinations of all described elements in this application should be considered disclosed by the description of the present application unless the context indicates otherwise.

In a first aspect, the present invention relates to a nucleic acid nanostructure comprising at least one scaffold strand and a plurality of staple strands, wherein said nanostructure, preferably said at least one scaffold strand, comprises at least one nucleic acid sequence encoding a gene.

In one embodiment, said nucleic acid nanostructure, preferably said at least one scaffold strand, comprises a first nucleic acid sequence encoding a gene and a second nucleic acid sequence encoding a gene; wherein, optionally, said nucleic acid nanostructure, preferably said at least one scaffold strand, comprises a plurality of nucleic acid sequences encoding a gene.

In one embodiment, said nucleic acid nanostructure comprises a first subunit and a second subunit; wherein, preferably, said first subunit and said second subunit each comprise a nucleic acid sequence encoding a gene.

In one embodiment, said nanostructure comprises an enhancer staple strand having a length in a range of from about 60 to about 250 nucleic acid bases, preferably from about 80 to about 220 nucleic acid bases, more preferably from about 90 to about 200 nucleic acid bases;

wherein, optionally, said enhancer staple strand is configured such that it binds to said scaffold strand at a 5' end and/or 3' end of said nucleic acid sequence encoding a gene.

In one embodiment, said nanostructure comprises an enhancer staple strand having a length in a range of from about 60 to about 250 nucleic acid bases, preferably from about 80 to about 220 nucleic acid bases, more preferably from about 90 to about 200 nucleic acid bases;

wherein, optionally, said enhancer staple strand comprises a nucleic acid sequence which is complementary to a nucleic acid sequence of said scaffold strand, wherein said nucleic acid sequence of said scaffold strand is located at a 5' end and/or 3' end of said nucleic acid sequence encoding a gene.

In one embodiment, said nanostructure, preferably said scaffold strand and/or at least one staple strand of said plurality of staple strands, comprises a nucleic acid sequence configured to form a loop structure, preferably an inverted-terminal repeat nucleic acid sequence configured to form a hairpin. In one embodiment, said nanostructure, preferably said scaffold strand and/or at least one staple strand of said plurality of staple strands, comprises a loop structure, preferably a hairpin.

In one embodiment, said nucleic acid sequence configured to form a loop structure is configured such that a loop is formed at a 5' end and/or 3' end of said nucleic acid sequence encoding a gene.

In one embodiment, said nanostructure, preferably said scaffold strand and/or at least one staple strand of said plurality of staple strands, comprises a loop structure, preferably a hairpin, at a 5' end and/or 3' end of said nucleic acid sequence encoding a gene. In one embodiment, said nanostructure, preferably said at least one scaffold strand, comprises at least one nuclear targeting sequence, preferably a DNA nuclear targeting sequence, more preferably a simian virus 40 DNA nuclear targeting sequence; wherein, optionally, said nanostructure, preferably said at least one scaffold strand, comprises a plurality of nuclear targeting sequences.

In one embodiment, said nanostructure, preferably said at least one scaffold strand, comprises a promoter such as a CMV promoter, a terminator, a polyadenylation signal sequence, an intron, a kozak sequence, and/or a woodchuck hepatitis virus posttranscriptional regulatory element.

In one embodiment, said nanostructure has an aspect ratio in the range of from about 1:1 to about 1000:1, preferably 1.5:1 to about 20:1, more preferably from about 2:1 to about 15:1.

In one embodiment, said scaffold strand comprises said at least one nucleic acid sequence encoding a gene, a promoter, and a terminator; optionally further comprises a nucleic acid sequence configured to form a loop structure, an intron, a DNA nuclear targeting sequence, a polyadenylation signal sequence, a Kozak sequence, and/or a woodchuck hepatitis virus posttranscriptional regulatory element.

In one embodiment, said scaffold strand comprises said at least one nucleic acid sequence encoding a gene, a promoter, and a terminator; wherein said scaffold strand optionally further comprises a loop structure, an intron, a DNA nuclear targeting sequence, a polyadenylation signal sequence, a Kozak sequence, and/or a woodchuck hepatitis virus posttranscriptional regulatory element.

In one embodiment, the nucleic acid sequence encoding a gene is a nucleic acid sequence encoding a eukaryotic gene, preferably a nucleic acid sequence encoding a mammalian gene, more preferably a nucleic acid sequence encoding a human gene.

In a further aspect, the present invention relates to a composition, preferably pharmaceutical composition, comprising a nucleic acid nanostructure as defined herein.

In a further aspect, the present invention relates to a collection of nucleic acid sequences or collection of plasmids encoding a nucleic acid nanostructure as defined herein.

In a further aspect, the present invention relates to a nucleic acid nanostructure, as defined herein, or composition, as defined herein, for use in medicine; preferably for use in a method of preventing, treating, and/or diagnosing a disease or disorder, preferably a genetic and/or immunological disease or disorder; optionally for use in gene therapy and/or immunotherapy.

In one embodiment, the nucleic acid nanostructure, as defined herein, or composition, as defined herein, is for use in gene therapy and/or immunotherapy.

In a further aspect, the present invention relates to a method of expressing a gene from a nucleic acid nanostructure, preferably a nucleic acid nanostructure as defined herein, comprising
  i) providing a nucleic acid nanostructure comprising at least one nucleic acid sequence encoding a gene, preferably a nucleic acid nanostructure as defined herein;
  ii) delivering said nucleic acid nanostructure provided in step i) to a cell; wherein, preferably, said delivering comprises transfecting or transforming said cell;
  iii) allowing said cell to express said gene;
  wherein, optionally, said providing in step i) comprises providing a plasmid, preferably a phagemid, or a collection of plasmids, preferably a collection of phagemids, wherein said plasmid or collection of plasmids encodes said nucleic acid nanostructure, and preparing said nucleic acid nanostructure using said plasmid or collection of plasmids, preferably by using bacteriophages.

In a further aspect, the present invention relates to a use of a nanostructure, as defined herein, or of a composition, as defined herein, for gene expression, preferably for in vitro gene expression.

In a further aspect, the present invention relates to a method of preventing, treating, and/or diagnosing a disease or disorder, preferably a genetic and/or immunological disease or disorder, comprising administering a nanostructure, as defined herein, or a composition, as defined herein, to a patient in need thereof.

In one embodiment, said method of preventing, treating, and/or diagnosing a disease or disorder is a method of gene therapy and/or immunotherapy.

In one embodiment, said administering comprises administering an effective amount of a nanostructure, as defined herein, and/or a composition, as defined herein, to a patient in need thereof.

In a further aspect, the present invention relates to a use of a nanostructure, as defined herein, or of a composition, as defined herein, for the manufacture of a medicament, e.g. a medicament for preventing, treating, and/or diagnosing a disease or disorder, preferably a genetic and/or immunological disease or disorder; optionally for gene therapy and/or immunotherapy.

In one embodiment, the nanostructure, as defined herein, or the composition, as defined herein, is used for the manufacture of a medicament for gene therapy and/or immunotherapy.

DETAILED DESCRIPTION

It is an aim of the invention to provide tools for efficiently expressing genes, such as eukaryotic genes e.g. mammalian genes. Particularly, it is an aim of the invention to provide nanostructures encoding two or more genes in controlled stoichiometric ratios. Furthermore, it is an aim of the invention to simultaneously deliver and express one or more genes, e.g. multiple genes. Moreover, it is an aim of the invention to efficiently deliver and express genes in vitro, ex vivo, and in vivo.

The inventors have successfully expressed genes from encoded DNA origami. Particularly, the inventors synthesized a library of custom ssDNA scaffolds for mammalian gene expression e.g. using bacteriophage-based production. The inventors found that genes were readily expressed from nucleic acid nanostructure, regardless of gene position in nanostructure, or nanostructure shape. The inventors found that gene expression can be even further enhanced with nucleic acid sequences configured to form a loop structure, e.g. adeno-associated virus-inspired inverted-terminal repeat (ITR) hairpin sequences, either upstream of the expression cassette, or flanking either side the expression cassette with the loop structure, e.g. ITR hairpin, featured on the staples. Overall, the inventors demonstrate highly efficient gene expression encoded within the nucleic acid nanostructure of the invention, particularly DNA origami structures of the invention.

The inventors have successfully delivered and expressed genes from encoded ssDNA scaffolds and customized DNA origami objects, as shown in FIG. 1a. The inventors found that nucleic acid nanostructures of the invention readily unfold within the intracellular environment and efficiently express genes from the ssDNA scaffold strand, and that gene expression can be further optimized with targeted staple design. The inventors further produced and tested a library of ssDNA scaffolds optimizing for increased gene expression, high-yield scaffold production and purity, and origami folding quality. Overall, the inventors find that, surprisingly, inclusion of at least one loop structure such as ITR secondary DNA structure, preferably upstream of the expression cassette, and/or the inclusion of one or more nuclear targeting sequences such as DTS sequences, e.g. three SV40 DTS sequences, enables a highly efficient and robust gene expression without compromising scaffold production or origami folding quality. Finally, the inventors demonstrate efficient and controlled assembly of gene-encoded origami structures in stoichiometric ratios. These "plug and play" architectured origami's enabled successful co-delivery and expression of an array of genes with unprecedented control.

Advantageously, the nanostructures of the invention exploit both the ability to encode for genetic information, together with the unique design possibilities of DNA origami structures. Thus, advantageously, the nanostructures of the invention allow to encode and express an array of genes in controlled stoichiometries.

The present invention relates to a nucleic acid nanostructure comprising at least one scaffold strand and a plurality of staple strands, wherein said nanostructure, preferably said at least one scaffold strand, comprises at least one nucleic acid sequence encoding a gene. Advantageously, one or more genes can be efficiently expressed using a nanostructure of the invention.

The term "nanostructure", as used herein, relates to a nucleic acid nanostructure, preferably a DNA origami structure which is composed of one or more DNA origami subunits. In one embodiment, the nanostructure comprises or consists of a DNA origami structure. Readily available nucleic acid nanostructure techniques e.g. DNA origami techniques, which involve comparatively less complex procedures to assemble nanostructures than standard nanomanufacturing techniques, may be used to manufacture the nanostructure. In one embodiment, the nanostructure is at least partially manufactured using DNA origami techniques. Owing to the self-assembly of DNA origami structures and the readily available software for designing the corresponding scaffold and staple strands, this is a comparatively less complex manufacturing process compared to standard nanomanufacturing techniques. In one embodiment, a nanostructure of the invention is a DNA origami structure. In one embodiment, the nanostructure of the invention has a maximum length smaller than 1000 nm, e.g. in the range of from about 10 nm to about 150 nm, preferably about 20 nm to about 100 nm.

In one embodiment, a nucleic acid nanostructure of the invention, e.g. a DNA origami structure, comprises at least one scaffold strand and a plurality of staple strands, e.g. single-stranded oligonucleotide staple strands. The term "staple strand", as used in this invention, shall refer to a single-stranded oligonucleotide molecule, which is at least partially complementary to a scaffold strand. In one embodiment, when referring to a "staple", a staple strand of a plurality of staple strands is meant. In general, staple strands can be used to introduce, e.g., coupling sites into a DNA origami structure and/or a DNA origami subunit. The term "plurality of staple strands", as used herein, relates to a plurality, e.g. at least three, staple strands. For example, a plurality of staple strands may relate to at least 3, 4, 5, 6, 7, 8, 9, 10, or more staple strands. In one embodiment, staple strands, particularly the staple strands of the plurality of staple strands, have a length of from 20 to 100 nucleic acid bases. In one embodiment, the staple strands of the plurality of staple strands have a length of from 20 to 80 nucleic acid bases, and the enhancer staple strand(s) has/have a length of from 90 to 250 nucleic acid bases. In one embodiment, the enhancer staple strand(s) differs from the staple strands of the plurality of staple strands in that it is at least 5, preferably at least 10 nucleic acid bases longer than each of the staple strands of the plurality of staple strands.

The term "scaffold strand" is a nucleic acid strand, preferably DNA strand, such as a single-stranded nucleic acid strand e.g. single-stranded polynucleotide strand. In one embodiment, a scaffold strand makes up and/or traverses the main part of a DNA origami structure and/or a DNA origami subunit. In one embodiment, a scaffold strand has a length of from 100 to 20000 nucleic acid bases, preferably from 120 to 15000 nucleic acid bases, more preferably from 260 to 11000 nucleic acid bases, e.g. from 1000 to 11000 nucleic acid bases. In one embodiment, said scaffold strand is a circular or linear scaffold strand. In one embodiment, said scaffold strand is a circular ssDNA scaffold strand. In one embodiment, the scaffold strand has a length of from 260 to 20000 nucleic acid bases, the enhancer staple strand(s) has/have a length of from 90 to 250 nucleic acid bases, and the staple strands of the plurality of staple strands have a length of from 20 to 80 nucleic acid bases.

The nanostructure, e.g. DNA origami structure, may comprise at least one scaffold strand, i.e. single-stranded polynucleotide scaffold DNA with a known sequence. The DNA origami structure may further comprise a plurality of single-stranded oligonucleotide staple strands, wherein each staple strand may be at least partially complementary to at least one scaffold strand. Further, each of the staple strands may be configured to bind to the at least one scaffold strand, wherein the at least one scaffold strand may be folded and/or arranged such that the desired nanostructure may be formed. The term "strand", as used herein, relates to a nucleic acid strand, e.g. a DNA and/or RNA strand, preferably a DNA strand. A three-dimensional nanostructure may be realized using DNA origami, i.e. by combining scaffold strands and staple stands to form the required portions and the overall device. Such designs may for example be performed using software such as caDNAno. That is, a nanostructure comprising multiple portions may in some embodiments be made out of one scaffold strand, whereas in other embodiments portions of a nanostructure may be constructed utilizing a plurality of scaffold strands.

In one embodiment, the shape of a nanostructure may be any shape, for example, a brick, a rod, a triangular shape, a round shape, a cuboid, i.e. a rectangular shape, a star shape, or any other shape. The nanostructure of this invention can be of any length. In a preferred embodiment, the nanostructure comprises a maximum length, and in a particularly preferred embodiment, the maximum length is smaller than 1000 nm, preferably smaller than 500 nm, such as around 100 nm, or smaller. In one embodiment, the terms "nano-structure", "nano-object", and "nucleic acid nanostructure" are used interchangeably.

In one embodiment, each of the staple strands is configured to bind to at least one of the at least one scaffold strand in at least one, preferably two or more distinct places. In one embodiment, a nucleic acid nanostructure of the invention, e.g. a DNA origami, comprises a scaffold strand and one or more staple strands. In one embodiment, a nucleic acid nanostructure of the invention comprises ≤100 staple strands. In one embodiment, the nucleic acid nanostructure of the invention comprises ≥10 DNA strands, preferably ≥15 DNA strands, e.g. at least one scaffold strand and at least nine staple strands.

The terms "DNA origami structure", "DNA origami" and "DNA origami objects", as used herein, relate to a nano-structure that comprises DNA as a building material to make nanoscale shapes. Preparing and/or providing a DNA ori-gami involves folding of one or more scaffold DNA strands into a defined shape using a plurality of rationally designed staple DNA strands, e.g. by self-assembly. A scaffold strand is typically longer than a staple strand. The nucleic acid sequences of the staple strands are designed such that the staple strands hybridize to defined portions of the scaffold strands and, due to the hybridization, a particular shape of the nanostructure is obtained.

In one embodiment, the term "nucleic acid", as used herein, relates to a nucleotide sequence, such as ribonucleic acid or deoxyribonucleic acid. In a preferred embodiment, the nucleic acid nanostructure is a DNA nanostructure. In a preferred embodiment, the nucleic acid nanostructure of the invention is a DNA origami structure. In a preferred embodiment, the nucleic acid nanostructure comprises or consists of a DNA origami structure. In one embodiment, the nucleic acid nanostructure is provided in the form of a DNA origami structure. An advantage of a nucleic acid nanostructure such as a DNA origami structure is that nucleic acid nanostructures such as DNA origami structures may comprise a plurality of genes, particularly in a desired stoichiometry, due to their rational design. Advantageously, with nucleic acid nanostructures such as DNA origami structures, the number of genes and their expression can be precisely controlled. Furthermore, the arrangement of the genes and further nucleic acid sequences of interest can be precisely controlled. A further advantage of nucleic acid nanostruc-tures such as DNA origami structures is that they can be stabilized against nucleases. In one embodiment, the nano-structure is configured such that it is stabilized against nucleases. A further advantage of DNA origami structures is that the assembly, e.g. self-assembly, and purification of the structure(s) are more robust and simple compared to non-DNA origami nucleic acid nanostructures such as DNA tetrahedrons or RNA assemblies. All embodiments described herein with respect to "a/the/said nucleic acid nanostructure" or "a/the/said nucleic acid nanostructure of the invention" are meant to be understood as also relating to the nanostructure(s) comprised by the composition of the invention, to the nanostructure used in accordance with the invention, and to the nanostructure(s) provided in any method of the invention.

The term "nucleic acid sequence encoding a gene", as used herein, relates to a nucleic acid sequence encoding any gene of interest, e.g. a gene involved in a pathological pathway, a gene suitable for a vaccination, and/or a CRISPR-based gene. In one embodiment, the gene is selected from prokaryotic genes, viral genes, and eukaryotic genes. In one embodiment, the gene is selected from pro-karyotic genes such as CRISPR-based genes and eukaryotic genes such as human genes. In a preferred embodiment, the gene is a eukaryotic gene, preferably a mammalian gene, e.g. a human gene. An advantage of the nucleic acid nano-structure of the invention is that it allows to express mam-malian genes, e.g. different mammalian genes with defined stoichiometries. A further advantage is that the nanostructure allows to express prokaryotic genes, e.g. for CRISPR-based gene editing, and viral genes, e.g. for DNA- or RNA-based vaccinations. In a preferred embodiment, the nucleic acid sequence encoding a gene encodes a eukaryotic gene, pref-erably mammalian gene, more preferably a human gene. In one embodiment, the nucleic acid nanostructure of the invention, preferably said at least one scaffold strand, com-prises a first nucleic acid sequence encoding a gene and a second nucleic acid sequence encoding a gene; wherein, optionally, said nucleic acid nanostructure, preferably said at least one scaffold strand, comprises a plurality of nucleic acid sequences encoding a gene. Advantageously, the nano-structure of the invention comprising a first nucleic acid sequence encoding a gene and a second nucleic acid sequence encoding a gene, e.g. comprising a plurality of nucleic acid sequences encoding a gene, allows to efficiently express genes of interest in a defined stoichiometry. In one embodiment, the first nucleic acid sequence encoding a gene and the second nucleic acid sequence encoding a gene each encode a eukaryotic gene, preferably a mammalian gene, more preferably a human gene. The nanostructure of the invention advantageously allows to express an array of genes in controlled stoichiometries. In one embodiment, the first nucleic acid sequence encoding a gene and the second nucleic acid sequence encoding a gene may encode the same gene or different genes. In one embodiment, the nanostruc-ture of the invention comprises one or several copies of a gene of interest, e.g. one or more nucleic acid sequences encoding a gene, such as one or more first nucleic acid sequence(s) encoding a gene and one or more second nucleic acid sequence(s) encoding a gene.

In one embodiment, the nucleic acid nanostructure com-prises a plurality of nucleic acid sequences encoding a gene. In one embodiment, each nucleic acid sequence encoding a gene of said plurality of nucleic acid sequences encoding a gene encodes for a different gene. In one embodiment, each nucleic acid sequence encoding a gene of said plurality of nucleic acid sequences encoding a gene encodes for a gene different from the genes encoded by the other nucleic acid sequences encoding a gene of said plurality of nucleic acid sequences encoding a gene. Thus, the plurality of nucleic acid sequences encoding a gene may comprise a plurality of encoded genes. In one embodiment, the nucleic acid sequence(s) encoding a gene is(are) positioned at any site of the nucleic acid nanostructure, preferably is(are) positioned at any site of the scaffold strand.

In one embodiment, said nucleic acid nanostructure com-prises a first subunit and a second subunit; wherein, prefer-ably, said first subunit and said second subunit each com-prise a nucleic acid sequence encoding a gene. The advantage of a nucleic acid nanostructure comprising a first subunit and a second subunit, e.g. a nucleic acid nanostructure comprising a plurality of subunits, is that each of the subunits may comprise one or more nucleic acid sequences encoding a gene, and thus the stoichiometry of multiple nucleic acid sequences encoding a gene can be rationally designed. In one embodiment, the nucleic acid nanostructure comprises a first subunit and a second subunit, optionally a plurality of subunits, which are stacked. In one embodiment, the nucleic acid nanostructure comprises two or more stacked subunits comprising a first subunit and the second subunit. In one embodiment, the first subunit and the second subunit each comprises a nucleic acid sequence encoding a gene, wherein the nucleic acid sequence encoding a gene comprised by the first subunit is the same or is different from the nucleic acid sequence encoding a gene comprised by the second subunit. In one embodiment, the first subunit and the second subunit encode the same or different genes. In one embodiment, the first subunit comprises a first nucleic acid sequence encoding gene and the second subunit comprises a second nucleic acid sequence encoding a gene. In one embodiment, the first subunit and the second subunit, optionally each subunit of a plurality of subunits, each comprise a scaffold strand and a plurality of staple strands. In one embodiment, the nucleic acid nanostructure comprises a first subunit and a second subunit, wherein each subunit comprises a scaffold strand comprising a nucleic acid sequence encoding a gene and wherein each subunit comprises a plurality of staple strands, optionally wherein at least one subunit comprises an enhancer staple strand. The subunits of the nucleic acid nanostructure may be connected by any means, e.g. by shape complementarity, by nucleotide base-stacking interactions, by nucleic acid mediated interaction such as by base pairing, and/or by covalent binding such as disulfide bridges. Advantageously, an assembly of multiple DNA origami subunits containing multiple genes can be achieved in controlled stochiometric ratios (FIG. 6) to enable the simultaneous delivery of multiple components. This is of particular importance in areas such as CRISPR-based technologies, for gene/base editing or epigenetic modulation. Further, production of virus-like particles (VLPs), lentiviruses and adeno-associated viruses, etc. additionally requires delivery of multiple components in controlled ratios.

In one embodiment, said nanostructure comprises an enhancer staple strand having a length in a range of from about 60 to about 250 nucleic acid bases, preferably from about 80 to about 220 nucleic acid bases, more preferably from about 90 to about 200 nucleic acid bases, e.g. about 154 bases. In one embodiment, said enhancer staple strand is configured such that it binds to said scaffold strand at a 5' end and/or 3' end of said nucleic acid sequence encoding a gene. The inventors have found that an enhancer staple strand stabilizes the nanostructure and increases gene expression from the nanostructure. Furthermore, the inventors have found that, surprisingly, an efficient expression of genes such as mammalian genes can be achieved with a nanostructure comprising an enhancer staple strand. In one embodiment, the term "enhancer staple strand" relates to a staple strand having a length of at least 60 nucleic acid bases, preferably of at least 80 nucleic acid bases, more preferably of at least 90 nucleic acid bases, e.g. having a length in a range of from about 90 to about 250 nucleic acid bases. In one embodiment, the terms "enhancer staple strand", "staple strand having a length of at least 60 nucleic acid bases", "continuous staple strand", and "stabilizing staple strand" are used interchangeably. In one embodiment, the enhancer staple strand binds to said scaffold strand such that one or multiple continuous double-helical domains with the scaffold are formed which comprise at least 10 nucleic acid base pairings, preferably at least 15 nucleic acid base pairings, more preferably at least 20 nucleic acid base pairings, even more preferably at least 30 nucleic acid base pairings, even more preferably at least 80, 85, or 90 nucleic acid base pairings. In one embodiment, enhancer staple strands provide a long region of dsDNA to help with recognition and binding of the polymerase and/or other helper proteins needed for gene expression.

The staple strands of the plurality of staple strands typically cross from one region of a scaffold strand over to other regions of the scaffold strand, thereby creating a folding pattern. The staple strands of the plurality of staple strands typically cross multiple regions of the scaffold strand. In contrast thereto, the enhancer staple strand performs less or none of these typical crosses, such that it remains continuous along one region or two regions of the scaffold strand. In one embodiment, the enhancer staple strand binds to said scaffold strand along one region or two regions of the scaffold strand. In one embodiment, the enhancer staple strand binds to said scaffold strand along one region or two regions of consecutive nucleic acids of the nucleic acid sequence of the scaffold strand. In one embodiment, the enhancer staple strand comprises or consists of one or two parts, wherein, if the enhancer staple strand comprises or consists of one part, at least 90% of the nucleic acid bases of said one part bind to a region of said scaffold strand, and wherein, if the enhancer staple strand comprises or consists of two parts, at least 90% of the nucleic acid bases of the first part of said two parts bind to a first region of said scaffold strand and at least 90% of the nucleic acid bases of the second part of said two parts bind to a second region of said scaffold strand. In one embodiment, the enhancer staple strand is arranged such that it is or at least a part of it is substantially parallel to a longitudinal extension of said nanostructure. In one embodiment, the term "enhancer" in the expression "enhancer staple strand" means that the enhancer staple strand binds to at least 10, preferably at least 15, more preferably at least 20, even more preferably at least 30, even more preferably at least 80, 85, or 90 consecutive nucleic acids of a nucleic acid sequence of said scaffold strand; wherein, preferably, the assembling of the nanostructure and the gene expression therefrom are enhanced. In one embodiment, said scaffold strand comprises said nucleic acid sequence encoding a gene, and said enhancer staple strand binds to at least 10, preferably at least 15, more preferably at least 20, even more preferably at least 30, even more preferably at least 80, 85, or 90 consecutive nucleic acids of a nucleic acid sequence of said scaffold strand at a 5' end and/or 3' end of said nucleic acid sequence encoding a gene. In one embodiment, said enhancer staple strand binds to at least 10, preferably at least 15, more preferably at least 20, even more preferably at least 30, even more preferably at least 80, 85, or 90 consecutive nucleic acids of a nucleic acid sequence of said scaffold strand at a 5' end of said nucleic acid sequence encoding a gene and said enhancer staple strand binds to at least 10, preferably at least 15, more preferably at least 20, even more preferably at least 30, even more preferably at least 80, 85, or 90 consecutive nucleic acids of a nucleic acid sequence of said scaffold strand at a 3' end of said nucleic acid sequence encoding a gene. For example, the enhancer staple strand may have a first part, e.g. a first half, and second part, e.g. a second half, and said first part, e.g. first half, binds to at least 10, preferably at least 15, more preferably at least 20, even more preferably at least 30, even more preferably at least 80, 85, or 90 consecutive nucleic acids of a nucleic acid sequence of said scaffold strand at a 5' end of said nucleic acid sequence encoding a gene and said second part, e.g. a second half, binds to at least 10, preferably at least 15, more preferably at least 20, even more preferably at least 30, even more preferably at least 80, 85, or 90 consecutive nucleic acids of a nucleic acid sequence of said scaffold strand at a 3' end of said nucleic acid sequence encoding a gene. The inventors have surprisingly found that a enhancer staple strand placed flanking either side of the expression cassette leads to a significant increase in transfection efficiency and gene expression. In one embodiment, the scaffold strand comprises said nucleic acid sequence encoding a gene and a polyadenylation signal sequence, wherein, optionally, an enhancer staple strand binds to said scaffold strand at a 5' end of said nucleic acid sequence encoding a gene and at a 3' end of said polyadenylation signal sequence. In one embodiment, the enhancer staple strand is configured such that it binds to said scaffold strand such that a circular structure, e.g. a circular scaffold strand or a circular expression cassette, is formed.

In one embodiment, said nanostructure, preferably said scaffold strand and/or at least one staple strand of said plurality of staple strands, comprises a nucleic acid sequence configured to form a loop structure, preferably an inverted-terminal repeat nucleic acid sequence configured to form a hairpin. For example, a loop structure is formed when two regions of nucleic acid strands, e.g. two regions of the same strand, typically complementary in nucleotide sequence when read in opposite directions, base-pair to form a double helix that ends in an unpaired loop. For example, an inverted-terminal repeat nucleic acid sequence may be a single stranded sequence of nucleotides followed downstream by its reverse complement. The intervening sequence of nucleotides between an initial sequence and the reverse complement thereof can be any length including zero. Advantageously, a nanostructure comprising a nucleic acid sequence configured to form a loop structure, e.g. an inverted-terminal repeat nucleic acid sequence, such as an adeno-associated virus-inspired inverted-terminal repeat (ITR) hairpin sequence, shows highly effective gene expression. In one embodiment, the nanostructure, e.g. said scaffold strand and/or at least one staple strand of said plurality of staple strands of said nanostructure, comprise(s) a nucleic acid sequence configured to form a loop structure, preferably an inverted-terminal repeat nucleic acid sequence such as an adeno-associated virus-inspired inverted-terminal repeat hairpin sequence. In one embodiment, said nucleic acid sequence configured to form a loop structure is configured such that a loop is formed at a 5' end and/or 3' end of said nucleic acid sequence encoding a gene. In one embodiment, said scaffold strand comprises a nucleic acid sequence configured to form a loop structure, preferably upstream of said nucleic acid sequence encoding a gene, more preferably upstream of an expression cassette comprising said nucleic acid sequence encoding a gene. In one embodiment, a staple strand, e.g. a staple strand of a plurality of staple strands, comprises a nucleic acid sequence configured to form a loop structure, preferably a staple strand flanking either side of said nucleic acid sequence encoding a gene, more preferably flanking either side of an expression cassette comprising said nucleic acid sequence encoding a gene. In one embodiment, the nucleic acid sequence configured to form a loop structure comprises or consists of a sequence as defined in any of SEQ ID NO. 13-14. In one embodiment, said nanostructure comprises a nucleic acid sequence encoding a loop structure, preferably an inverted-terminal repeat nucleic acid sequence encoding a hairpin. In one embodiment, said nanostructure comprises a loop structure, preferably a hairpin. In one embodiment, the term "nucleic acid sequence encoding a loop structure", as used herein, relates to a nucleic acid sequence configured to form a loop structure. In one embodiment, the nucleic acid sequence configured to form a loop structure is configured such that the loop is formed by the nucleic acid sequence configured to form a loop structure alone, or by the nucleic acid sequence configured to form a loop structure and a further nucleic acid sequence e.g. a further nucleic acid sequence configured to form a loop structure. In one embodiment, the nucleic acid nanostructure comprises a first nucleic acid sequence configured to form a loop structure and a second nucleic acid sequence configured to form a loop structure. In one embodiment, the first and second nucleic acid sequences configured to form a loop structure each form a loop structure and/or jointly form a loop structure. The inventors have surprisingly found that an enhancement of gene expression efficiency can be achieved by including nucleic acid sequences encoding a loop structure such as adeno-associated virus-inspired inverted-terminal repeat (ITR) hairpin sequences, for example either upstream of the expression cassette or flanking either side of the expression cassette with the loop structure featured on the staple strands. In one embodiment, said nucleic acid sequence configured to form a loop structure is located upstream or downstream of the nucleic acid sequence encoding a gene, particularly upstream or downstream of an expression cassette. In one embodiment, said loop structure is formed upstream or downstream of the nucleic acid sequence encoding a gene, particularly upstream or downstream of an expression cassette. In one embodiment, said nucleic acid sequence configured to form a loop structure is located on one or two staple strands binding to said scaffold strand upstream or downstream of the nucleic acid sequence encoding a gene, particularly upstream or downstream of an expression cassette.

In one embodiment, said nanostructure, preferably said at least one scaffold strand, comprises at least one nuclear targeting sequence, preferably a DNA nuclear targeting sequence, more preferably a simian virus 40 DNA nuclear targeting sequence; wherein, optionally, said nanostructure, preferably said at least one scaffold strand, comprises a plurality of nuclear targeting sequences. In one embodiment, the nuclear targeting sequence comprises or consists of a sequence as defined in SEQ ID NO. 21. DNA nuclear targeting sequences (DTSs) are consensus motifs recognized by transcription factors, and can be used to shuttle DNA from the cytosol through nuclear pores to the nucleus. For instance, the simian virus 40 DNA nuclear targeting sequence (SV40 DTS) can be used as a DTS since it is recognized by various TFs. Advantageously, a nanostructure comprising one or more DTS sequences, such as three SV40 DTS sequences, enables a highly efficient and robust gene expression. In one embodiment, the nucleic acid nanostructure comprises one, two, or three nuclear targeting sequences, preferably DNA nuclear targeting sequences. The inventors have surprisingly found that the transfection efficiency can be further increased with inclusion of nuclear targeting sequences, e.g. DNA nuclear targeting sequences such as the SV40 (simian vacuolating virus 40) DTS, within the nanostructure, preferably the scaffold strand. The inventors have found a maximum effect with an inclusion of 1-3 nuclear targeting sequence repeats such as 1-3 SV40 sequence repeats, for both dividing and non-dividing (arrested) cells (FIG. 5).

In one embodiment, said nanostructure, preferably said at least one scaffold strand, comprises a promoter such as a CMV promoter, a terminator, a polyadenylation signal sequence, an intron, a kozak sequence, and/or a woodchuck hepatitis virus posttranscriptional regulatory element. Promoters are typically sequences of DNA to which proteins bind to initiate transcription of a single RNA transcript from the DNA downstream of the promoter, e.g. bacterial or eukaryotic promoters such as mammalian promoters. Terminators, particularly transcription terminators, are typically a section of nucleic acid sequence that marks the end of a gene or operon during transcription, e.g. mammalian terminators such as SV40, hGH, BGH, and rbGlob terminators. In one embodiment, the terminator is a SV40 terminator, hGH terminator, BGH terminator, or rbGlob terminator. For example, the terminator mediates transcriptional termination by providing signals in the newly synthesized transcript RNA that trigger processes which release the transcript RNA from the transcriptional complex. Polyadenylation is the addition of a poly(A) tail to an RNA transcript, typically a messenger RNA (mRNA). A poly(A) tail enhances the nuclear export, translation and stability of mRNA. Polyadenylation signal sequences typically comprise a consensus sequence for the addition of a poly(A) tail (polyadenylation) and/or a terminator sequence. In one embodiment, the polyadenylation signal sequence comprises an AAUAAA-motif. In one embodiment, the polyadenylation signal sequence comprises or consists of a sequence as defined in SEQ ID NO. 19. The kozak sequence may be a nucleic acid motif that functions as the protein translation initiation site in the transcript, e.g. an eukaryotic mRNA transcript. In one embodiment, the kozak sequence comprises or consists of a sequence as defined in SEQ ID NO. 16. The woodchuck hepatitis virus posttranscriptional regulatory element may be a DNA sequence that, when transcribed, creates a tertiary structure enhancing expression. In one embodiment, the woodchuck hepatitis virus posttranscriptional regulatory element comprises or consists of a sequence as defined in SEQ ID NO. 17.

In one embodiment, said nucleic acid nanostructure, preferably said at least one scaffold strand and/or at least one staple strand of said plurality of staple strands of said nanostructure, comprise(s) a nucleic acid sequence configured to form a loop structure, preferably an inverted-terminal repeat nucleic acid sequence such as an adeno-associated virus-inspired inverted-terminal repeat hairpin sequence, and a promoter such as a CMV promoter, a terminator, a polyadenylation signal sequence, an intron, a kozak sequence, and/or a woodchuck hepatitis virus posttranscriptional regulatory element (WPRE), optionally wherein said at least one scaffold strand of said nucleic acid nanostructure is a ssDNA scaffold strand.

In one embodiment, said nucleic acid nanostructure, preferably said at least one scaffold strand and/or at least one staple strand of said plurality of staple strands of said nanostructure, comprise(s) an inverted-terminal repeat nucleic acid sequence such as an adeno-associated virus-inspired inverted-terminal repeat hairpin sequence, and a promoter, such as a CMV promoter, a terminator, a polyadenylation signal sequence, at least one nucleic acid sequence encoding a gene, a kozak sequence, and/or a woodchuck hepatitis virus posttranscriptional regulatory element (WPRE), optionally wherein said at least one scaffold strand of said nucleic acid nanostructure is a ssDNA scaffold strand.

In one embodiment, said nucleic acid nanostructure, preferably said at least one scaffold strand and/or at least one staple strand of said plurality of staple strands of said nanostructure, comprise(s) an adeno-associated virus-inspired inverted-terminal repeat hairpin sequence, and a promoter, such as a CMV promoter, a polyadenylation signal sequence, at least one nucleic acid sequence encoding a gene, a kozak sequence, and a woodchuck hepatitis virus posttranscriptional regulatory element (WPRE), optionally wherein said at least one scaffold strand of said nucleic acid nanostructure is a ssDNA scaffold strand.

In one embodiment, said nucleic acid nanostructure, preferably said at least one scaffold strand and/or at least one staple strand of said plurality of staple strands of said nanostructure, comprise(s) an adeno-associated virus-inspired inverted-terminal repeat hairpin sequence, and a CMV promoter, a polyadenylation signal sequence, at least one nucleic acid sequence encoding a gene, a kozak sequence, and a woodchuck hepatitis virus posttranscriptional regulatory element (WPRE), optionally wherein said at least one scaffold strand of said nucleic acid nanostructure is a ssDNA scaffold strand.

In one embodiment, said at least one scaffold strand of said nucleic acid nanostructure is a ssDNA scaffold strand, wherein said nucleic acid nanostructure comprise(s) an adeno-associated virus-inspired inverted-terminal repeat hairpin sequence, and a CMV promoter, a polyadenylation signal sequence, at least one nucleic acid sequence encoding a gene, a kozak sequence, and a woodchuck hepatitis virus posttranscriptional regulatory element (WPRE).

In one embodiment, said nucleic acid nanostructure is a ssDNA scaffold strand, wherein said nucleic acid nanostructure comprise(s) an adeno-associated virus-inspired inverted-terminal repeat hairpin sequence, a CMV promoter, a polyadenylation signal sequence, at least one nucleic acid sequence encoding a gene, a kozak sequence, and a woodchuck hepatitis virus posttranscriptional regulatory element (WPRE).

In one embodiment, said nucleic acid nanostructure, preferably said at least one scaffold strand and/or at least one staple strand of said plurality of staple strands of said nanostructure, comprise(s) a promoter, such as a CMV promoter, a terminator, a polyadenylation signal sequence, an intron, a kozak sequence, and/or a woodchuck hepatitis virus posttranscriptional regulatory element (WPRE), and one or more nuclear targeting sequences, such as one or more DTS sequences, for example one or more SV40 DTS sequences, optionally wherein said at least one scaffold strand of said nucleic acid nanostructure is a ssDNA scaffold strand.

In one embodiment, said nucleic acid nanostructure, preferably said at least one scaffold strand and/or at least one staple strand of said plurality of staple strands of said nanostructure, comprise(s) a promoter, such as a CMV promoter, a terminator, a polyadenylation signal sequence, at least one nucleic acid sequence encoding a gene, a kozak sequence, and/or a woodchuck hepatitis virus posttranscriptional regulatory element (WPRE), and one or more nuclear targeting sequences, such as one or more DTS sequences, for example one or more SV40 DTS sequences, optionally wherein said at least one scaffold strand of said nucleic acid nanostructure is a ssDNA scaffold strand.

In one embodiment, said nucleic acid nanostructure, preferably said at least one scaffold strand and/or at least one staple strand of said plurality of staple strands of said nanostructure, comprise(s) a promoter, such as a CMV promoter, a polyadenylation signal sequence, at least one nucleic acid sequence encoding a gene, and one or more nuclear targeting sequences, such as one or more DTS sequences, for example one or more SV40 DTS sequences, optionally wherein said at least one scaffold strand of said nucleic acid nanostructure is a ssDNA scaffold strand.

In one embodiment, said nucleic acid nanostructure, preferably said at least one scaffold strand and/or at least one staple strand of said plurality of staple strands of said nanostructure, comprise(s) a promoter, such as a CMV promoter, a polyadenylation signal sequence, at least one nucleic acid sequence encoding a gene, and one or more SV40 DTS sequences, optionally wherein said at least one scaffold strand of said nucleic acid nanostructure is a ssDNA scaffold strand.

In one embodiment, said nucleic acid nanostructure, preferably said at least one scaffold strand and/or at least one staple strand of said plurality of staple strands of said nanostructure, comprise(s) a promoter, such as a CMV promoter, a polyadenylation signal sequence, at least one nucleic acid sequence encoding a gene, and one or three SV40 DTS sequences, optionally wherein said at least one scaffold strand of said nucleic acid nanostructure is a ssDNA scaffold strand.

In one embodiment, said nucleic acid nanostructure, preferably said at least one scaffold strand and/or at least one staple strand of said plurality of staple strands of said nanostructure, comprise(s) a promoter, such as a CMV promoter, a polyadenylation signal sequence, at least one nucleic acid sequence encoding a gene, and one or three SV40 DTS sequences, wherein said at least one scaffold strand of said nucleic acid nanostructure is a ssDNA scaffold strand.

In one embodiment, said nucleic acid nanostructure, preferably said at least one scaffold strand and/or at least one staple strand of said plurality of staple strands of said nanostructure, comprise(s) a CMV promoter, a polyadenylation signal sequence, at least one nucleic acid sequence encoding a gene, and one or three SV40 DTS sequences, wherein said at least one scaffold strand of said nucleic acid nanostructure is a ssDNA scaffold strand.

In one embodiment, said nucleic acid nanostructure, preferably said at least one scaffold strand and/or at least one staple strand of said plurality of staple strands of said nanostructure, comprise(s) a CMV promoter, a polyadenylation signal sequence, at least one nucleic acid sequence encoding a gene, and three SV40 DTS sequences, wherein said at least one scaffold strand of said nucleic acid nanostructure is a ssDNA scaffold strand, and the shape of the nanostructure is a triangular shape.

According to this invention, the term "ssDNA" shall refer to single stranded DNA. Accordingly, the term "ssDNA scaffold" shall refer to a single stranded DNA scaffold, and the term "ssDNA scaffold strand" shall refer to a single stranded DNA scaffold strand.

In one embodiment, said nanostructure has an aspect ratio in the range of from about 1:1 to about 1000:1, preferably 1.5:1 to about 20:1, more preferably from about 2:1 to about 15:1. In one embodiment, the aspect ratio is the ratio of the sizes of the nanostructure in different dimensions, e.g., a ratio of the longitudinal extension to a transverse extension. In one embodiment, the nanostructure has a maximum longitudinal extension along said longitudinal axis which is larger than a maximum transverse extension along said transverse axis. For example, a nanostructure having an aspect ratio of 20:1 may have a longitudinal extension of 20 nm and a transverse extension of 1 nm.

In one embodiment, said scaffold strand comprises said at least one nucleic acid sequence encoding a gene, a promoter, and a terminator; optionally further comprises a nucleic acid sequence configured to form a loop structure, an intron, a DNA nuclear targeting sequence, a polyadenylation signal sequence, a Kozak sequence, and/or a woodchuck hepatitis virus posttranscriptional regulatory element. In one embodiment, said nanostructure, preferably, said scaffold strand, comprises an expression cassette comprising said at least one nucleic acid sequence encoding a gene, a promoter, and a terminator; optionally further comprising a nucleic acid sequence configured to form a loop structure, an intron, a DNA nuclear targeting sequence, a polyadenylation signal sequence, a Kozak sequence, and/or a woodchuck hepatitis virus posttranscriptional regulatory element.

In a further aspect, the present invention relates to a composition, preferably a pharmaceutical composition, comprising a nucleic acid nanostructure as defined herein. In one embodiment, the composition, preferably pharmaceutical composition, comprises a pharmaceutically acceptable excipient. The composition, preferably pharmaceutical composition, of the invention shall be formulated to be compatible with its intended route of administration. In a particularly preferred embodiment, examples of routes of administration of the pharmaceutical and/or nanostructure of this invention include intravenous, oral, intranasal, intrathecal, intra-arterial, intradermal, subcutaneous, transdermal (topical), intracerebroventricular, intraparenchymal, intratumoral, transmucosal, rectal, vaginal, bronchial, parenteral administration, and any other clinically/medically accepted method for administration of a pharmaceutical and/or a compound.

In a further aspect, the present invention relates to a collection of nucleic acid sequences or collection of plasmids encoding a nucleic acid nanostructure as defined herein. In one embodiment, the collection of nucleic acid sequences comprises or consists of one or more nucleic acid sequences encoding a nucleic acid nanostructure as defined herein. In one embodiment, the collection of nucleic acid sequences comprises a scaffold strand and a plurality of staple strands. In one embodiment, the collection of plasmids comprises or consists of one or more plasmids encoding a nucleic acid nanostructure as defined herein. In one embodiment, the plasmid is a phagemid. In one embodiment, the collection of plasmids is a collection of phagemids.

In a further aspect, the present invention relates to a nucleic acid nanostructure, as defined herein, or composition, as defined herein, for use in medicine. In one embodiment, the nucleic acid nanostructure, as defined herein, or composition, as defined herein, is for use in a method of preventing, treating, and/or diagnosing a disease or disorder, preferably a genetic and/or immunological disease or disorder. In one embodiment, the nucleic acid nanostructure, as defined herein, or composition, as defined herein, is for use in gene therapy and/or immunotherapy. Advantageously, the nanostructure of the invention allows to efficiently express genes, such as mammalian genes, which is highly useful for the prevention, treatment, and diagnosis of genetic diseases or disorders and of immunological diseases or disorders. For example, the nanostructures of the invention can be used for gene therapy and immunotherapy by administering the nanostructures to a patient in need thereof, and expressing genes from said nanostructure in said patient, e.g. genes deficient in said patient and/or genes involved in a pathology. In one embodiment, said gene therapy and/or immunotherapy comprises or consists of a vaccination, preferably a vaccination using said nanostructure or composition.

In a further aspect, the present invention relates to a method of expressing a gene from a nucleic acid nanostructure, preferably a nucleic acid nanostructure as defined herein, comprising i) providing a nucleic acid nanostructure comprising at least one nucleic acid sequence encoding a gene, preferably a nucleic acid nanostructure as defined herein;

ii) delivering said nucleic acid nanostructure provided in step i) to a cell; wherein, preferably, said delivering comprises transfecting or transforming said cell;

iii) allowing said cell to express said gene;

wherein, optionally, said providing in step i) comprises providing a plasmid, preferably a phagemid, or a collection of plasmids, preferably a collection of phagemids, wherein said plasmid or collection of plasmids encodes said nucleic acid nanostructure, and preparing said nucleic acid nanostructure using said plasmid or collection of plasmids, preferably by using bacteriophages. In one embodiment, said collection of plasmids is a collection of plasmids as defined herein.

In one embodiment, said method of expressing a gene is an in vitro or ex vivo method. In one embodiment, delivering said nanostructure to said cell comprises contacting said nanostructure with said cell, optionally further comprising electroporation, lipofection, endocytosis such as chemically induced endocytosis and/or receptor-mediated endocytosis, phagocytosis, membrane fusion, heat shock, calcium phosphate, liposomes, nanoparticles, biolistics, microinjection, sonoporation, photoporation, magnetofection, and/or hydroporation. In one embodiment, said delivering in step ii) is performed using electroporation, lipofection, endocytosis such as chemically induced endocytosis and/or receptor-mediated endocytosis, phagocytosis, membrane fusion, heat shock, calcium phosphate, liposomes, nanoparticles, biolistics, microinjection, sonoporation, photoporation, magnetofection, and/or hydroporation. For example, chemically induced endocytosis may comprise peptide-targeted endocytosis, protein-targeted endocytosis, polysaccharide-targeted endocytosis, carbohydrate-targeted endocytosis, lipid-targeted endocytosis, and/or aptamer-targeted endocytosis.

In one embodiment, said allowing said cell to express said gene in step iii) comprises cultivating said cell(s) in a cell culture, preferably at a temperature in a range of from about 25° C. to about 40° C., preferably of from about 30° C. to about 38° C., more preferably at about 37° C., e.g. for about 1 h to about 72 h. In one embodiment, said allowing said cell(s) to express said gene in step iii) comprises providing suitable growth conditions for said cell. In one embodiment, said cell is a eukaryotic or prokaryotic cell, e.g. a mammalian cell, a fungal cell, a yeast cell, or a bacterial cell. In one embodiment, said cell is a mammalian cell.

In one embodiment, in the context of a method of the invention, the term "providing a nucleic acid nanostructure" comprises providing an assembled nucleic acid nanostructure and/or providing a building material for a nucleic acid nanostructure, such as a scaffold strand and one or more staple strands. In one embodiment, a method of preparing a nanostructure comprises a step of allowing self-assembly of a nanostructure and purifying said self-assembled nanostructure. For example, providing a nucleic acid nanostructure may comprise a step of allowing self-assembly and subsequent purification. In one embodiment, allowing self-assembly comprises mixing at least one scaffold strand and one or more staple strands, optionally further comprises adjusting the ionic strength, e.g. by adding about 10 mM to about 20 mM $MgCl_2$, and/or further comprises using a temperature protocol running a sequence of temperatures. In one embodiment, said purifying comprises removing the remaining excess of staple strands, e.g. by a precipitation such as PEG-precipitation, filtration, and/or liquid chromatography. In one embodiment, self-assembly and/or a step of allowing self-assembly comprises a step of denaturation and a step of cooling. In one embodiment, a step of denaturation is performed at a temperature of from 50° C. to 80° C., preferably 60° C. to 70° C., e.g. about 65° C., for a period of from 1 minute to 45 minutes, preferably 10 to 20 minutes, e.g. about 15 minutes. In one embodiment, a step of cooling is performed at a temperature of from 0° C. to 70° C., preferably 20° C. to 60° C., e.g., about 50° C. to 58° C. In a preferred embodiment, a step of cooling is performed as a gradual cooling, preferably at a temperature from about 58° C. to about 50° C. with a decrease of 1° C. per hour. A person skilled in the art understands that the protocol for self-assembly depends on the design and/or nucleic acid sequence of the nanostructure, and that the protocol can be adjusted in line with known protocols for preparing nanostructures.

In one embodiment, when referring to a method, the method is an in vivo, ex vivo, in vitro, or in situ method, e.g. an in vitro method. In one embodiment, when referring to a use, the use is an in vivo, ex vivo, in vitro, or in situ use, e.g. an in vitro use. In one embodiment, the nanostructure of the invention is for use in vivo or in vitro, preferably in vivo.

In a further aspect, the present invention relates to a use of a nanostructure, as defined herein, or of a composition, as defined herein, for gene expression, preferably for in vitro gene expression. For example, the nanostructure of the invention can be used to efficiently express molecules of interest, for example proteins of interest, in cell culture, e.g. for large-scale production of therapeutic proteins such as mammalian enzymes or antibodies.

In a further aspect, the present invention relates to a method of preventing, treating, and/or diagnosing a disease or disorder, preferably a genetic and/or immunological disease or disorder, comprising administering a nanostructure, as defined herein, or a composition, as defined herein, to a patient in need thereof. In one embodiment, said method of preventing, treating, and/or diagnosing a disease or disorder is a method of gene therapy and/or immunotherapy. In one embodiment, said administering comprises administering an effective amount of a nanostructure, as defined herein, and/or a composition, as defined herein, to a patient in need thereof. The term "patient", as used herein, may relate to a human or an animal. The term "effective amount", as used herein, relates to an amount sufficient to evoke a desired effect, e.g. a sufficient labeling for in vivo imaging.

In a further aspect, the present invention relates to a use of a nanostructure, as defined herein, or of a composition, as defined herein, for the manufacture of a medicament, e.g. a medicament for preventing, treating, and/or diagnosing a disease or disorder, preferably a genetic and/or immunological disease or disorder; optionally for gene therapy and/or immunotherapy. For example, the nanostructure may comprise genes which are deficient in a patient.

The terms "of the [present] invention", "in accordance with the invention", "according to the invention" and the like, as used herein are intended to refer to all aspects and embodiments of the invention described and/or claimed herein.

As used herein, the term "comprising" is to be construed as encompassing both "including" and "consisting of", both meanings being specifically intended, and hence individually disclosed embodiments in accordance with the present invention. Where used herein, "and/or" is to be taken as specific disclosure of each of the two specified features or components with or without the other. For example, "A and/or B" is to be taken as specific disclosure of each of (i) A, (ii) B and (iii) A and B, just as if each is set out individually herein. In the context of the present invention, the terms "about" and "approximately" denote an interval of accuracy that the person skilled in the art will understand to still ensure the technical effect of the feature in question. The term typically indicates deviation from the indicated numerical value by $\pm 20\%$, $\pm 15\%$, $\pm 10\%$, and for example $\pm 5\%$. As will be appreciated by the person of ordinary skill, the specific such deviation for a numerical value for a given technical effect will depend on the nature of the technical effect. For example, a natural or biological technical effect may generally have a larger such deviation than one for a man-made or engineering technical effect. Where an indefinite or definite article is used when referring to a singular noun, e.g. "a", "an" or "the", this includes a plural of that noun unless something else is specifically stated.

BRIEF DESCRIPTION OF THE FIGURES

The present invention is now further described by reference to the following figures.

All methods mentioned in the figure descriptions below were carried out as described in detail in the examples.

FIGS. 1A-1E show folding and expressing genes from origami structures, and the impact of gene position and origami aspect ratio on gene expression. FIG. 1A, Schematics of the overall workflow: ssDNA is produced from plasmid DNA via phagemids (i), and then folded into 20 helix bundle (20HB) DNA origami objects (ii). Objects were delivered to cells, and gene expression from the origami structure was assessed by detection of positive fluorescence read-out (iii). FIG. 1B, Cylinder models and negative-staining transmission electron micrographs of the 20HB, 12HB and 32 HB are given in the upper and lower panels, respectively (scale bar 100 nm, insets 20 nm), (HB: helix bundles). 20HB-ext demonstrates the CMV, EGFP and polyA encoding sequences present along exterior helices, while 20HB-int presents the sequences encoding for EGFP and polyA within interior helices. FIG. 1C, Transfection efficiency in HEK293T cells (sc: scaffold; st: staples). FIG. 1D, Schematics explaining internal crosslinking via UV irradiation. UV-welded structures 20HB-ext-W and 20HB-int-W, EGFP expression was silenced. FIG. 1E, Transfection efficiency in HEK293T cells by electroporation seen for 20HB(-ext), 32HB and 12HB structures. Data collected in FIG. 1C and FIG. 1E were quantified using flow cytometry and are presented as mean±standard deviation (s.d.) for n=3 biologically independent experiments. Individual data points are overlaid. Statistical analysis was performed using one-way ANOVA with Tukey's multiple comparison (*$p \le 0.05$, ns $p > 0.05$).

FIG. 2C, TEM micrographs of 20HB-LPv2 and 20HB-Circ, scale bar 100 nm. FIG. 2D, Delivery into HEK293T cells via electroporation revealed statistically significant increased transfection efficiency for samples 20HB-LP, 20HB-LPv2 and 20HB-Circ, when compared to the standard 20HB (20HB-LP comprising two 93-mer continuous staples (enhancer staples)). FIG. 2E, Scaffold used until now has encoded for the 'coding strand', where the expression cassette is present in the 5' to 3' direction ("sc_EGFP1", upper panel). Scaffold encoding for the reverse complementary sequence of the expression cassette, thus the "template strand" ("sc_EGFP2", lower panel) was designed and produced. FIG. 2F, HEK293T cells transfected with either sc_EGFP2 scaffold+staple mixture, or scaffold only, demonstrated significantly higher transfection efficiency than that of the sc_EGFP1 counterpart. No significant difference in the transfection efficiency from 20HB structures was observed. FIG. 2G, EGFP mean fluorescence intensity (MFI) for 20HB, 20HB-LPv2 and 20HB-Circ structures folded with either the coding or the template strand as the scaffold. Structures 20HB and 20HB-Circ demonstrated no significant difference in MFI, while a significant difference was observed for structure 20HB-LPv2. Data collected in FIG. 2D, FIG. 2F and FIG. 2G were quantified using flow cytometry and are presented as mean±s.d. for n=3 biologically independent experiments, individual data points are overlaid. Statistical analysis in FIG. 2D was performed using one-way ANOVA with Tukey's multiple comparison, while statistical analysis for FIG. 2F and FIG. 2G was performed using Student's t-tests (*$p \le 0.05$, $p \le 0.01$, *$p \le 0.001$, ****$p \le 0.0001$, ns $p > 0.05$). Advantageously, an efficient gene expression is achieved with a nanostructure comprising the nucleic acid sequence encoding a gene in the scaffold strand and with a nanostructure comprising the nucleic acid sequence encoding a gene in the plurality of staple strands.

FIGS. 3A-3C shows enhancing gene expression through alternative scaffold sequences. FIG. 3A, Scaffold designs where sc_EGFP1 represents the initial scaffold design, and sc_EGFP3/4/5/6 include additional sequence features such as ITRs, or ITR binding domains (ITR*), kozak sequence, and WPRE. FIG. 3B and FIG. 3C, Comparison of transfection efficiency as determined by EGFP+ cells (FIG. 3B) and mean fluorescent intensity of EGFP+ cells (FIG. 3C). Data collected in a and b were quantified using flow cytometry and are presented as mean±s.d. for n=3 biologically independent experiments, individual data points are overlaid. Statistical analysis was performed using one-way ANOVA with Tukey's multiple comparison (*$p \le 0.05$, $p \le 0.01$, *$p \le 0.001$, ****$p \le 0.0001$, ns $p > 0.05$).

FIGS. 4A-4D show enhancing gene expression through scaffold sequence design. FIG. 4A, 20HB design for the sc_EGFP5 structure included an external single stranded loop to allow the ITR sequence to self-anneal and form the hairpin structure. 20HB design for the sc_EGFP6 scaffold included two external loops to expose the ITR binding domain, enabling the ITR hairpin staples to anneal. FIG. 4B, FIG. 4C Transfection efficiency and MFI seen for 20HB structures folded with sc_EGFP5 and sc_EGFP6. Data collected in FIG. 4B and FIG. 4C were quantified using flow cytometry and are presented as mean±s.d. for n=3 biologically independent experiments, individual data points are overlaid. Statistical analysis in FIG. 4B and FIG. 4C was performed using one-way ANOVA with Tukey's multiple comparison, (*$p \le 0.05$, *$p \le 0.001$, **$p \le 0.0001$, ns $p > 0.05$). FIG. 4D, Representative epifluorescence microscopy images showing EGFP expression from cells transfected with DNA origami objects folded with sc_EGFP5 and sc_EGFP6 relative to sc_EGFP1. Images in the bottom row have been purposely contrast enhanced to reveal EGFP positive cells that have poor EGFP intensity in the sc_EGFP1 sample. The images are representative of one of n=3 biologically independent experiments; similar results were observed each time. Scale bar 100 μm.

FIG. 5A, Comparison of transfection efficiency (%) and EGFP MFI (A.U.) across all structures investigated, grouped by scaffold. sc_EGFP1 20HB-ext was used as an internal control in all experiments, and EGFP MFI is represented as fold change compared to this sample. Three clusters are highlighted: 1, structures with high folding quality but low overall gene expression; 2, structures with low folding quality and medium expression levels; 3, structures with medium to high folding quality and high expression levels. FIG. 5B, Representative epifluorescent microscopy images showing the expression of EGFP by successfully transfected HEK293T cells after optimization of electroporation settings. For each of the conditions, eGFP expression, cell (phase contrast) and the overlay are given. The images are representative of one of n=2 biologically independent experiments; similar results were observed each time. Scale bar 100 μm.

FIG. 7A, Agarose gel demonstrating all custom scaffolds produced, and the corresponding purified DNA origami structures. FIG. 7B, Representative negative stain TEM images showing the 20HB DNA origami structures for each of the custom scaffolds produced. Scale bar 100 nm.

FIG. 8C, Flow cytometry histogram plot demonstrating cell cycle populations of actively dividing and chemically arrested HEK293T cells. (FIG. 8D) Quantification of mCherry+ cells (%) in dividing and chemically arrested HEK293T populations 24 h after electroporation with the 20HB-mCh.

FIG. 9A, Transfection efficiency (bar graph) and mean fluorescence intensity (square symbols) 24 h after electroporation with DNA origami structures containing one or several DTS compared to the control structure, with no DTS sequence, in normally dividing HEK293T cells. FIG. 9B, Transfection efficiency (bar graph) and mean fluorescent intensity (square symbols) 24 h after electroporation with DNA origami structures containing one or several DTS compared to the control structure, with no DTS sequence, in arrested HEK293T cells. The data were quantified using flow cytometry and are presented as mean values ±s.d. for n=3 biologically independent experiments. One-way ANOVA was performed to test statistically significant differences in gene expression compared to the control. For normally dividing cells (FIG. 9A), the inclusion of one copy of the SV40 DTS resulted in a statistically significant increase in transfection efficiency (*p≤0.05) and mean fluorescence intensity (p≤0.01) compared to the control without DTS sequence. For arrested cells (FIG. 9B), the inclusion of three copies of the SV40 DTS resulted in a statistically significant increase in transfection efficiency (p≤0.01) and mean fluorescence intensity (**p≤0.0001) compared to the control without DTS sequence. The inclusion of one copy did not result in a statistically significant increased transfection efficiency but did result in a statistically significant increase in mean gene expression (**p≤0.0001) for arrested cells.

FIG. 10A, Cylindrical models of DNA origami objects for programmed assembly via shape-complementary protrusions and recesses. Schematic demonstrates unique interaction patterns to build dimer (i), trimer (i and ii) and tetramer (i, ii, iii and iv) higher-order assemblies. FIG. 10B, Representative comparison tomogram slice through dimer, trimer and tetramer structures, scale bar 100 nm, taken from a sample with mixed assembly products. FIG. 10C, Schematic demonstrating passivated overhangs for inhibiting assembly, and assembly assisted via complementary 5 nt sticky ends. FIG. 10D, Cotransfection (mCherry+/EGFP+) efficiency in HEK293T cells after delivery of mCherry and EGFP as individual monomers (Pass.), or as a dimer connected through 5 nt or 8 nt sticky ends. FIG. 10E, Cotransfection (mCherry+/EGFP+) efficiency in HEK293T cells with assembly multimeric DNA origami structures including mCherry and EGFP-encoded monomers in ratios of 1:1, 1:2 and 1:3 mCherry:EGFP. EGFP MFI (A.U.) is given on the right y-axis. Data collected in FIG. 10D and FIG. 10E were quantified using flow cytometry and are presented as mean±s.d. for n=3 biologically independent experiments, individual data points are overlaid. Statistical analysis in FIG. 10D and FIG. 10E was performed using one-way ANOVA with Tukey's multiple comparison, (*p≤0.05, p≤0.01, ns p>0.05). FIG. 10F**, Top: schematic design of mCherry and EGFP monomer blocks for no assembly (passivated), or assembly into dimer, trimer or tetramer structures in the ratio of 1:1, 1:2 and 1:3 mCherry:EGFP, from left to right. Bottom: representative epifluorescent microscopy images demonstrated the expression of mCherry, EGFP, or coexpression by successfully transfected HEK293T cells. Cell nuclei are labeled, scale bar 100 μm. The images are representative of one of n=3 biologically independent experiments; similar results were observed each time.

FIG. 1A, Scaffold design with three SV40 DTS sequences for production of custom scaffolds, wherein the phagemid encoding mCherry has 8064 bases. FIG. 1B, Representative negative stain TEM images showing the mCherry-encoding DNA origami structures (triangular structures) for the custom scaffolds produced. Scale bar: 50 nm. FIG. 11C, Representative epifluorescence microscopy images showing mCherry expression from HEK293T cells transfected with DNA origami objects, 48 hours after electroporation of mCherry-encoding origami triangles. Scale bar: 50 μm.

Figures 1A, 1B:
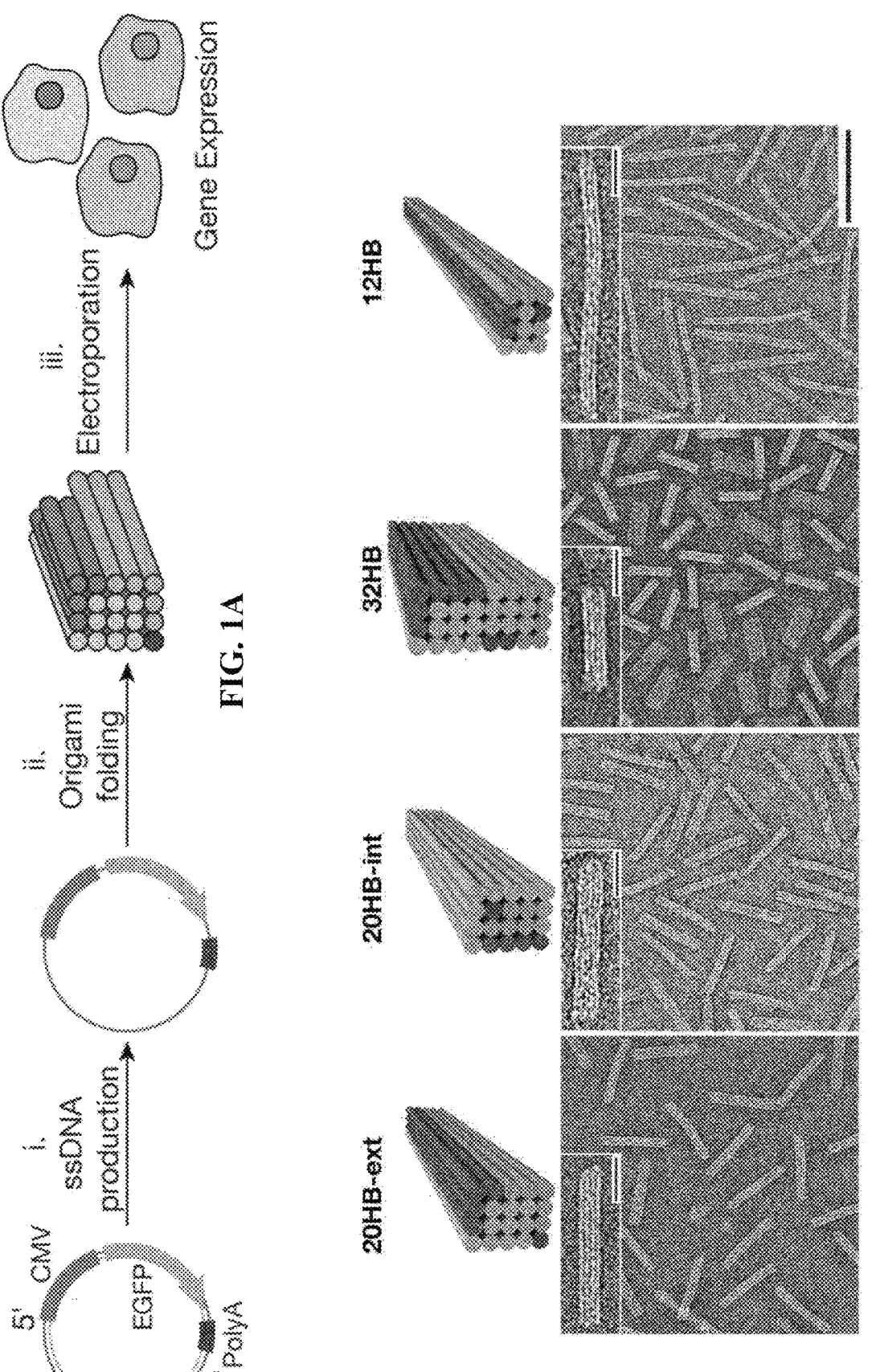

In the following, reference is made to the examples, which are given to illustrate, not to limit the present invention.

EXAMPLES

Example 1: Materials and Methods

Scaffold Production.

The design and cloning methods of our customized scaffolds are given in detail in Examples 2 and 6. In brief, gene fragments from EGFP-containing plasmids (Addgene plasmids #13031 and #105530, with and without ITR sequences respectively) were assembled with a fragment for phage origin of replication bacterial resistance (Addgene plasmid #126854) using either Golden Gate or digestion ligation cloning. Plasmids were verified using restriction digests and DNA sequencing (Eurofins® genomics, Ebersberg Germany). Exact primer sequences and methods can be found in Examples 2 and 6, and sequences of the custom scaffolds can be found in SEQ ID NOs 1-11. Exemplary sequences of staple strands can be found in SEQ ID NOs 76-1507.

Production of the ssDNA custom scaffolds was performed as previously described.[1,2] Briefly, chemically competent DH5α *E. coli* cells were cotransformed with the plasmid of interest, and a helper plasmid (Addgene plasmid #120346). Single colonies were picked and grown for ~10 h in a 5 mL pre-culture (2×YT, 30 µg/mL kanamycin, 30 µg/mL carbenicillin) before being transferred to 750 mL of 2×YT (30 µg/mL kanamycin, 30 µg/mL carbenicillin, 5 mM MgCl$_2$) in Ultra Yield® flasks (Thomson). Cells then were grown in a shaking incubator at 37° C. overnight. Bacteria were pelleted by centrifugation (45 min, 4500 g, and the supernatant collected. Phagemid particles were precipitated from the supernatant with addition of polyethylene glycol 8000 (PEG-8000, final concentration 3% w/w) and NaCl (final concentration 0.5 M) and incubated with stirring for 1 h at rt, before being collected by centrifugation (45 min, 4500 g, 4° C.). The pellet was resuspended in 4 mL of 1×TE buffer (10 mM Tris, 1 mM EDTA, pH 8) and centrifuged again (15 min, 16000 g, 4° C.) to remove residual bacterial components. The ssDNA scaffold was then extracted via phagemid lysis and purified via ethanol precipitation.

DNA Origami Design, Folding and Purification.

All origami objects were folded in standardized 'folding buffers' containing x mM MgCl$_2$ in addition to 5 mM Tris base, 1 mM EDTA and 5 mM NaCl, pH 8 (FoBx). All reactions were subjected to thermal annealing ramps in Tetrad® (Bio-Rad) thermal cycling devices. Exact folding conditions for each structure is given in Tables 2 and 3. Staple strands were purchased from Integrated DNA Technologies, as exemplified in Example 6, and used with standard desalting unless stated otherwise. Origami objects were purified by either PEG precipitation, or gel purification, as previously described.[3,4]

Assembly of Multi-Component DNA Origami Structures.

To assemble the origami subunits to form the dimer, trimer and tetramer samples, monomers were mixed in molar ratios in 1×FOB5 buffer and incubated for 48 h at 37° C. Passivated samples were treated identically.

UV Welding.

UV weldable samples were designed with additional thymine bases located at all potential staple crossover position, and UV-crosslinked as described previously [5] with UV light (310 nm, 2 h) using Asahi Spectra Xenon Light source (300 W, MAX-303) with a high transmission bandpass filter centered around 310 nm (XAQA310, Asahi Spectra). Samples were in F0B10 buffer at the time of UV-crosslinking.

PAGE Purification of Ultramers.

Long staple oligomers (93-mers, 154-mers and 200-mers) were purchased from IDT as ultramers and purified in-house via denaturing urea polyacrylamide gel electrophoresis (Urea-PAGE). Bands corresponding to the correct MW were cut away and crushed prior to the addition of 1×TEN buffer (10 mM Tris-HCl, 1 mM EDTA, 100 mM NaCl, pH 8.00). Pure ultramers were recovered via EtOH precipitation, redissolved in MilliQ H$_2$O, and stored at 4° C.

Gel Electrophoresis.

For characterization of PCR products and plasmids, 1% agarose gels containing 0.5×TBE buffer (22.25 mM tris base, 22.25 mM boric acid, 0.5 mM EDTA) were used. Gel electrophoresis was performed with an identical buffer solution for 1 h at a voltage of 110 V. To characterize assembled origami and scaffolds, the inventors used 2% agarose gels containing 0.5×TBE buffer and 5.5 mM MgCl$_2$. Gel electrophoresis was performed with an identical buffer solution for 1-2 h at a voltage of 90 V, gels were placed in a water bath for cooling. All gels were imaged using a Typhoon FLA 9500 laser scanner (GE Healthcare) with a pixel size of 50 µm/pixel.

Negative Staining TEM.

Samples were incubated on glow-discharged copper TEM grids (FCF400-CU, Electron Microscopy Sciences), for 30-60 s. Grids were then stained for 30 s (2% aqueous uranyl formate, 25 mM NaOH). Imaging was performed at magnifications of 21,000-42,000×. Data was acquired with SerialEM software, using a FEI Tecnai T12 microscope (120 kV, Tietz TEMCAM-F416 camera). Images were processed using ImageJ.[5] TEM micrographs were high-pass filtered to remove long-range staining gradients and the contrast was auto-leveled using Adobe Photoshop CS5.

The tilt series were performed from −50° to +50° and micrographs were acquired in 2° increments, the tomogram was then generated using a filtered back-projection, processed with Etomo (IMOD) to acquire tomograms.[6] The Gaussian-Filter used a cutoff between 0.25 and 0.5, and a fall-off of 0.035.

Cell Culture.

HEK293T cells (DSMZ) were cultured routinely in Dulbecco's modified Eagle's medium (DMEM, Gibco, cat. no. 31966047), supplemented with 10% heat-inactivated fetal bovine serum (FBS, Sigma-Aldrich, cat. No. F9665). Cells were grown in a humidified incubator at 37° C. with 5% CO$_2$.

Cell Cycle Arrest.

HEK293T cells were arrested for 24 h prior to electroporation using arrest media (DMEM supplemented 10% FBS and 5 ng/µL Aphidicolin, Sigma-Aldrich, cat. no. A0781, dissolved in dimethyl sulfoxide, DMSO, Sigma-Aldrich). Cells were kept in arresting media for the entire time of the experiment.

Electroporation.

Electroporation experiments were carried out according to the Manufacturer's protocol (Neon™ transfection protocol, ThermoFisher). Briefly, HEK293T cells were washed with phosphate buffered saline solution (PBS) and collected using TryplE. Cells were pelleted via centrifugation (5 min, 300 g), resuspended in PBS and counted. Cells were centrifuged again (5 min, 300 g), and then resuspended in Buffer R (Neon™ Transfection System) at a concentration of 5×10$^6$ cells/mL. Mixtures for each condition were prepared so that each electroporation event contained 0.5 g total DNA, and the volume was supplemented to a total of 1 µL with 1×FOB5 buffer (folding buffer, 1 mM Tris, 1 mM EDTA, 5 mM NaCl, 5 mM MgCl$_2$), which was mixed with 9 µL of the cell suspension. Electroporation occurred in the 10 µL transfection tips, with two pulses at pulse voltage of 1150 V and width of 20 ms. After electroporation, cells were immediately transferred to a 48 well plate which had been pre-prepared with a poly-L-lysine coating, and 240 µL of complete DMEM growth media or arresting media.

After 48 h, samples were imaged using the EVOS™ M7000 Imaging System, and the transfection efficiency was quantified via flow cytometry. For arrest experiments, the cells were analyzed 24 h after electroporation to avoid extensive cell death. Briefly, samples were acquired using Attune Nxt Flow Cytometer and software (Thermo Fisher).

In total, 20,000 single cell events, gated on side scatter area versus height, were recorded for analysis. EGFP was excited with a 488 nm laser, and emission was measured with a 530/30 nm bandpass filter. mCherry was excited with a 561 nm laser and emission was measured with a 620/15 nm bandpass filter. Untreated cells, and cells electroporated with buffer only, were used as negative controls. Cells electroporated with the corresponding EGFP plasmid was used as a positive control. Cell cycle arrest was confirmed by cell cycle analysis via flow cytometry. The cells were stained with FxCycle™ Far Red Stain (Invitrogen, Thermo Fisher Scientific) according to Manufacturer's protocol. The dye was excited with a 638 nm laser and emission was measured with a 670/14 nm bandpass filter. Data was analyzed post-acquisition using FlowJo software (v10.7.1).

Statistics and Reproducibility.

Statistical analyses were performed with GraphPad® Prism (GraphPad® Software Inc. v9). The data is illustrated as the mean±standard deviation, and the individual data points representing biological replicates are shown. The specific analysis performed is detailed in the corresponding figure caption. For all tests, differences were considered significant at $p \leq 0.05$ (*), $p \leq 0.01$ (), $p \leq 0.001$ (*), $p \leq 0.0001$ (****).

Example 2: Further Materials and Methods

Scaffold Cloning.

Plasmids encoding for custom scaffolds were created via standard cloning techniques. All plasmids, with the exception of sc_EGFP3, were created via Golden gate assembly using either Esp3I (NEB cat. no. R0734), or BsaI-HF® v2 (NEB cat. no. R3733), together with T4 DNA ligase (NEB cat. no. M0202). For each plasmid, appropriate cute sites were introduced with PCR, and the assembly was conducted as per manufacturer's protocol.

The exception, sc_EGFP3, was assembled via digestion ligation, and compatible enzyme cut sites were added to the fragment of interest by means of PCR. Enzymes EcoNI and PacI (NEB cat. no. R0521 and R0547 respectively) were used to digest fragments of interest, and then ligated using NEB T4 DNA ligase, as above.

Touchdown PCR with primers (see Table 1) for all constructs was performed. In all cases, PCR products were confirmed by agarose gel electrophoresis (AGE), bands were excised, and fragments were extracted (Qiagen QIAquick® Gel Extraction Kit) as per manufacturer's protocol.

TABLE 1

| Primer sequences used for the construction of plasmids for custom scaffold production. | | | |
|---|---|---|---|
| Plasmid | Template | Primer Sequence 5' - 3' | SEQ ID NO: |
| sc_EGFP1 | Addgene plasmid #126854 | FWD CTGGATGGTCTCCgtgacattaagcgcggcgggtg | SEQ ID NO: 22 |
| | | REV CTGGATGGTCTCCaatgagtgagcaaaaggccagca | SEQ ID NO: 23 |
| | Addgene plasmid #13031 | FWD CTGGATGGTCTCCcattgatatacgcgttgacattga | SEQ ID NO: 24 |
| | | REV CTGGATGGTCTCCtcacattccgcctcagaagccat | SEQ ID NO: 25 |
| sc_EGFP2 | Addgene plasmid #126854 | FWD CACTGACGTCTCTgtgacattaagcgcggcgggtg | SEQ ID NO: 26 |
| | | REV CACTGACGTCTCTaatgagtgagcaaaaggccagca | SEQ ID NO: 27 |
| | Addgene plasmid #13031 | FWD CACTGACGTCTCTcattcgcctcagaagccataga | SEQ ID NO: 28 |
| | | REV CACTGACGTCTCTtcacagatatacgcgttgacattga | SEQ ID NO: 29 |
| sc_EGFP3 | Addgene plasmid #105530 | FWD TTAATTAAcattaagcgcggcgggtgt | SEQ ID NO: 30 |
| | | REV CCTAATTAAGGgtgagcaaaaggccagcaaa | SEQ ID NO: 31 |
| sc_EGFP4 | sc_EGFP3 | FWD CACTGACGTCTCTcattatgctctaggaagatcggaa | SEQ ID NO: 32 |
| | | REV CGTGATCGTCTCTaatgtaagggtgagcaaaaggcca | SEQ ID NO: 33 |
| sc_EGFP5 | sc_EGFP3 | FWD CACTGACGTCTCTcattgccttaattaacattaagcgc | SEQ ID NO: 34 |
| | | REV CACTGACGTCTCTaatgcgccatgctacttatctacg | SEQ ID NO: 35 |
| sc_EGFP6 | sc_EGFP3 | FWD AGATGGCGTCTCCttaggggcctcagtgagcgagcg | SEQ ID NO: 36 |
| | | REV AGATGGCGTCTCCaggggcctcagtgagcgagcg | SEQ ID NO: 37 |
| | | FWD AGATGGCGTCTCCcccttaattaacattaagcgcg | SEQ ID NO: 38 |
| | | REV AGATGGCGTCTCCctaatTAAGGgtgagcaaaagg | SEQ ID NO: 39 |

TABLE 1-continued

Primer sequences used for the construction of plasmids
for custom scaffold production.

| Plasmid | Template | | Primer Sequence 5' - 3' | SEQ ID NO: |
|---|---|---|---|---|
| sc_mCherry5 | sc_EGFP5 | FWD | TGGCTACGTCTCGgtgattggatccaatcaacctctg | SEQ ID NO: 40 |
| | | REV | TGGCTACGTCTCGaatgcctggacacctgtggaga | SEQ ID NO: 41 |
| | Addgene plasmid | FWD | TGGCTACGTCTCGcattattcgccaccatggtgag | SEQ ID NO: 42 |
| | #127813 | REV | TGGCTACGTCTCGtcacccgctcacttgtacagct | SEQ ID NO: 43 |
| sc_mCherry | Addgene plasmid | FWD | CAAGGTGGTCTCCgtgacattaagcgcggcgggtg | SEQ ID NO: 44 |
| | #126854 | REV | CAAGGTGGTCTCCaatgagtgagcaaaaggccagca | SEQ ID NO: 45 |
| | Addgene plasmid | FWD | CAAGGTGGTCTCGcattcgcgatgtacgggccaga | SEQ ID NO: 46 |
| | #128744 | REV | CAAGGTGGTCTCGtcacagagccccagctggttctt | SEQ ID NO: 47 |
| sc_mCherry_ | Addgene plasmid | FWD | TTTCCGGGTCTCGgtgacattaagcgcggcgggtg | SEQ ID NO: 48 |
| 1xSV40 | #126854 | REV | TTTCCGGGTCTCGaatgagtgagcaaaaggccagca | SEQ ID NO: 49 |
| | sc_mCherry | FWD | TTTCCGGGTCTCCcattgtacgggccagatatacg | SEQ ID NO: 50 |
| | | REV | TTTCCGGGTCTCCATctctagactcgagcggcc | SEQ ID NO: 51 |
| | sc_mCherry | FWD | TTTCCGGGTCTCCGCtttaaacccgctgatcagc | SEQ ID NO: 52 |
| | | REV | TTTCCGGGTCTCCtcacaggttctttccgcctcaga | SEQ ID NO: 53 |
| sc_mCherry_ | sc_mCherry_ | FWD | TTGTGGGGTCTCGgcctcgactgtgccttctag | SEQ ID NO: 54 |
| 3xSV40_ | 1xSV40 | REV | TTGTGGGGTCTCGgagcggccgctcacttgtacagc | SEQ ID NO: 55 |
| intermedi-ate | | | | |
| | sc_mCherry_ | FWD | TTGTGGGGTCTCGgctcgagtctagagatccg | SEQ ID NO: 56 |
| | 1xSV40 | REV | TTGTGGGGTCTCGtttggttgctgactaattgag | SEQ ID NO: 57 |
| | sc_mCherry_ | FWD | TTGTGGGGTCTCGcaaagctctagagatccggtgtgg | SEQ ID NO: 58 |
| | 1xSV40 | REV | TTGTGGGGTCTCGgatggtttaaagctttggttgct | SEQ ID NO: 59 |
| | sc_mCherry_ | FWD | TTGTGGGGTCTCGcatccggtgtggaaagtcc | SEQ ID NO: 60 |
| | 1xSV40 | REV | TTGTGGGGTCTCGaggctgatcagcgggtttaa | SEQ ID NO: 61 |
| sc_mCherry_ | sc_mCherry | FWD | TTCGAGGGTCTCCttgtgacattaagcgcggc | SEQ ID NO: 62 |
| 3xSV40 | | REV | TTCGAGGGTCTCCcttacccggccctctaga | SEQ ID NO: 63 |
| | sc_mCherry | FWD | TTCGAGGGTCTCGtaaggagggcccgtttaaaccc | SEQ ID NO: 64 |
| | | REV | TTCGAGGGTCTCGagccatagagcccaccgcat | SEQ ID NO: 65 |
| | sc_mCherry | FWD | TTCGAGGGTCTCGgctcgctttcttgctgtcc | SEQ ID NO: 66 |
| | | REV | TTCGAGGGTCTCGcatccccagtttagtagttgg | SEQ ID NO: 67 |
| | sc_mCherry_ | FWD | CAAGAGGGTCTCCatgcggccgctcgagtctag | SEQ ID NO: 68 |
| | 3xSV40 | REV | CAAGAGGGTCTCCgaggctgatcagcgggtt | SEQ ID NO: 69 |
| | intermediate | | | |
| | Addgene plasmid | FWD | AACACCGGTCTCGgactacaacaaggcaaggct | SEQ ID NO: 70 |

TABLE 1-continued

|        | Primer sequences used for the construction of plasmids for custom scaffold production. | | | |
|--------|--------|-----|------|------|
| Plasmid | Template | | Primer Sequence 5' - 3' | SEQ ID NO: |
|        | #128744 | REV | AACACCGGTCTCGacaaagcagcgcaaaacgcct | SEQ ID NO: 71 |
| sc_mCherry_ | sc_mCherry_ | FWD | GTACACGGTCTCGgactatacgcgttgacattgattat | SEQ ID NO: 72 |
| 6xSV40 | 3xSV40 | REV | GTACACGGTCTCGccaatgagtgagcaaaaggcc | SEQ ID NO: 73 |
|        | sc_mCherry_ | FWD | GTACACGGTCTCGttggggatgcggccgctcga | SEQ ID NO: 74 |
|        | 3xSV40 | REV | GTACACGGTCTCGagtcgaggctgatcagcgg | SEQ ID NO: 75 |

DNA Origami Folding.

Nucleic acid nanostructures, for example CS3_EGFP3, CS3_EGFP1, CS3_EGFP4, CS3_EGFP4A, CS3_EGFP4B, CS3_EGFP5, were successfully produced. The nucleic acid nanostructures were folded using the conditions defined in tables 2 and 3.

TABLE 2

Folding conditions summary for each of the structures and scaffolds used.

| Scaffold | Structure | Program | 10× Folding Buffer | v(scaffold, 100 nM,) μL* | v(staples, 100 μM), μL* |
|----------|-----------|---------|--------------------|--------------------------|-------------------------|
| sc_EGFP1 | 20HB-ext | 3 | FoB10 | 10 | 8 |
|          | 20HB-int | 1 | FoB10 | 10 | 8 |
|          | 20HB-ext-W | 1 | FoB15 | 10 | 8 |
|          | 20HB-int-W | 1 | FoB15 | 10 | 8 |
|          | 32HB | 1 | FoB20 | 10 | 8 |
|          | 12HB | 2 | FoB10 | 10 | 8 |
|          | 20HB LS | 3 | FoB15 | 10 | 8 |
|          | 20HB LP | 1 | FoB20 | 10 | 8 |
|          | 20HB LPv2 | 1 | FoB20 | 10 | 8 |
|          | 20HB Circ | 3 | FoB10 | 10 | 8 |
| sc_EGFP2 | 20HB | 1 | FoB10 | 10 | 8 |
|          | 20HB LPv2 | 3 | FoB15 | 10 | 8 |
|          | 20HB Circ | 3 | FoB10 | 10 | 8 |
| sc_EGFP3 | 20HB | 5 | FoB20 | 2.5 | 8‡ |
| sc_EGFP4 | 20HB | 2 | FoB15 | 10 | 8 |
| sc_EGFP5 | 20HB | 3 | FoB15 | 4 | 14 |
|          | 20HB loop | 5 | FoB10 | 4 | 8 |
|          | 20HB loop LPv2 | 4 | FoB15 | 4 | 8 |
|          | 16HB_2 | 7 | FoB12.5 | 10 | 8 |
|          | 16HB_3 | 7 | FoB25 | 10 | 8 |
|          | 16HB_4 | 7 | FoB7.5 | 10 | 8 |
| sc_EGFP6 | 20HB | 2 | FoB15 | 4 | 14 |
|          | 20HB LPv2 | 6 | FoB10 | 4 | 8 |
| sc_mCherry5 | 16HB_1 | 1 | FoB10 | 10 | 8 |
| sc_mCherry | 20HB-mCh | 1 | FoB10 | 4 | 8 |
| sc_mCherry_1xSV40 | 20HB-1xSV40 | 1 | FoB15 | 10 | 8 |
| sc_mCherry_3xSV40 | 20HB-3xSV40 | 2 | FoB25 | 4 | 14 |
| sc_mCherry_6xSV40 | 20HB-6xSV40 | 8 | FoB15 | 10 | 8 |

*For 20 μL folding reaction, where necessary volume supplemented to 20 μL total with ddH₂O.
‡Staples used here were at 500 μM concentration.

55

TABLE 3

Folding programs used for the folding reactions.

| | 1. Denaturation time | | | 3. Storage |
|---------|------|--------|---------------------|-------------|
| Program | 30 s | 15 min | 2. Temperature ramp | temperature |
| 1 | — | 65° C. | 60-44° C., at 1° C./1 h | 20° C. |
| 2 | — | 65° C. | 60-44° C., at 1° C./2 h | 20° C. |
| 3 | 70° C. | 65° C. | 60-35° C., at 1° C./1 h | 20° C. |
| 4 | 70° C. | 65° C. | 60-35° C., at 1° C./2 h | 20° C. |
| 5 | 70° C. | 65° C. | 60-35° C., at 1° C./4 h | 20° C. |

60
65

TABLE 3-continued

Folding programs used for the folding reactions.

| | 1. Denaturation time | | | 3. Storage |
|---------|------|--------|---------------------|-------------|
| Program | 30 s | 15 min | 2. Temperature ramp | temperature |
| 6 | 70° C. | 65° C. | 60-30° C., at 1° C./1 h | 20° C. |
| 7 | — | 65° C. | 60-44° C., at 1° C./4 h | 20° C. |
| 8 | — | 65° C. | 60-25° C., at 1° C./2 h | 20° C. |

Example 3: Analysis of Structure Integrity

The structure integrity of the nucleic acid nanostructure of the invention was analyzed. For example, 20 HB structure integrity after electroporation was analyzed. Structural integrity of the 20 HB was maintained when diluted in RPMI 1640 media. Furthermore, 20 HBs were stable in both the electroporation buffer (EB, buffer R in kit) and after electroporation using the Neon™ transfection system. The nucleic acid nanostructure of the invention shows an advantageous structural integrity.

Example 4: Results

Genes are Readily Expressed from DNA Origami Independent of Gene Position or Origami Shape.

The inventors first investigation was to determine basic parameters of origami design that mammalian cells will express. To do this, the inventors created a customized circular ssDNA scaffold which encoded for an enhanced green fluorescent protein (EGFP) in the 5' to 3' direction (coding strand), as given in FIG. 1A. Thus, cells which successfully express EGFP from the nucleic acid nanostructure can be monitored via fluorescence detection. The inventors use two observables in this study: the fraction of cells showing green fluorescence (termed transfection efficiency), and the fluorescence intensity per cell which the inventors use as a proxy for expression efficiency. The inventors used electroporation as the method to deliver the origami directly to the cell in order to circumnavigate issues such as cellular uptake and endosomal escape, which could confound data interpretation, and rather focus on parameters directly affecting expression. The inventors used electroporation via the Neon™ transfection system which did not compromise (and prevented aggregation of) the DNA origami structures.

The custom EGFP scaffold (sc_EGFP1) expressed in high yield and purity via phagemid production, and the scaffold folded efficiently into the designed target objects (FIG. 1B). To address whether the spatial position of the gene within the DNA origami object affects expression, the inventors designed two 20-helix bundles (20HBs) variants where the EGFP gene was positioned either on the exterior (20HB-ext) or in the interior (20HB-int) of the multi-layer DNA origami (FIG. 1B, first two panels). Gene expression occurred from both 20HB variants in human embryonic kidney 293T (HEK293T) cells after electroporation (FIG. 1C). The inventors found no statistically significant difference in either the transfection or expression efficiency from the two objects.

The aspect ratio of DNA origami has previously been reported to influence cellular uptake[7,8]. To elucidate whether aspect ratio influences expression, the inventors designed a ~114 nm long twelve-helix bundle (12HB), a ~69 nm long 20HB-ext and a ~42 nm long 32HB with the EGFP gene and recognition sequences presented in all cases on the exterior of the bundles (FIG. 1B). These objects have aspect ratios of ~15, 5 and 2 for the 12HB, 20HB and 32HB, respectively. The EGFP and associated genes are presented in the 12HB as long continuous regions with minimal scaffold crossovers, while the 32HB presents them within the shortest continuous regions. When delivered to HEK293T cells the inventors found no statistically significant difference in transfection and expression efficiency from the 20HB and the 32HB samples (FIG. 1E). A small decrease in transfection efficiency was seen from the 12HB sample (p 0.05) relative to 20HB and 32HB. However, the cell density after electroporation was also lower for the 12HB object.

Hence, for both transfection and expression efficiency it did not matter how the gene of interest was packaged among our panel of test DNA origami. This observation suggested that unfolding of the DNA origami occurs prior to gene expression. The inventors tested this hypothesis with EGFP encoding objects that cannot unfold. To this end the inventors included extra thymidine residues in the staple strands for 20HB-ext and 20HB-int to enable internal crosslinking via UV point welding.[9] The objects were then internally stabilized by several hundred UV-induced cyclobutane pyrimidine dimer bonds between staple strands and at crossovers, which topologically prevents strand dissociation (FIG. 1D). When the inventors delivered the UV point welded 20HB variants to the HEK293T cells, the inventors found almost complete suppression of the EGFP signal (FIG. 1C). While exposure to UV radiation can also have a inhibitory effect on gene expression from plasmids[10,11], the pronounced, near-complete inhibition of gene expression from the covalently crosslinked DNA origami supports the inventors hypothesis that DNA origami must unfold prior for gene expression.

Targeted Design Changes in Promoter Region Enhance Gene Expression.

Figures 2A, 2B:
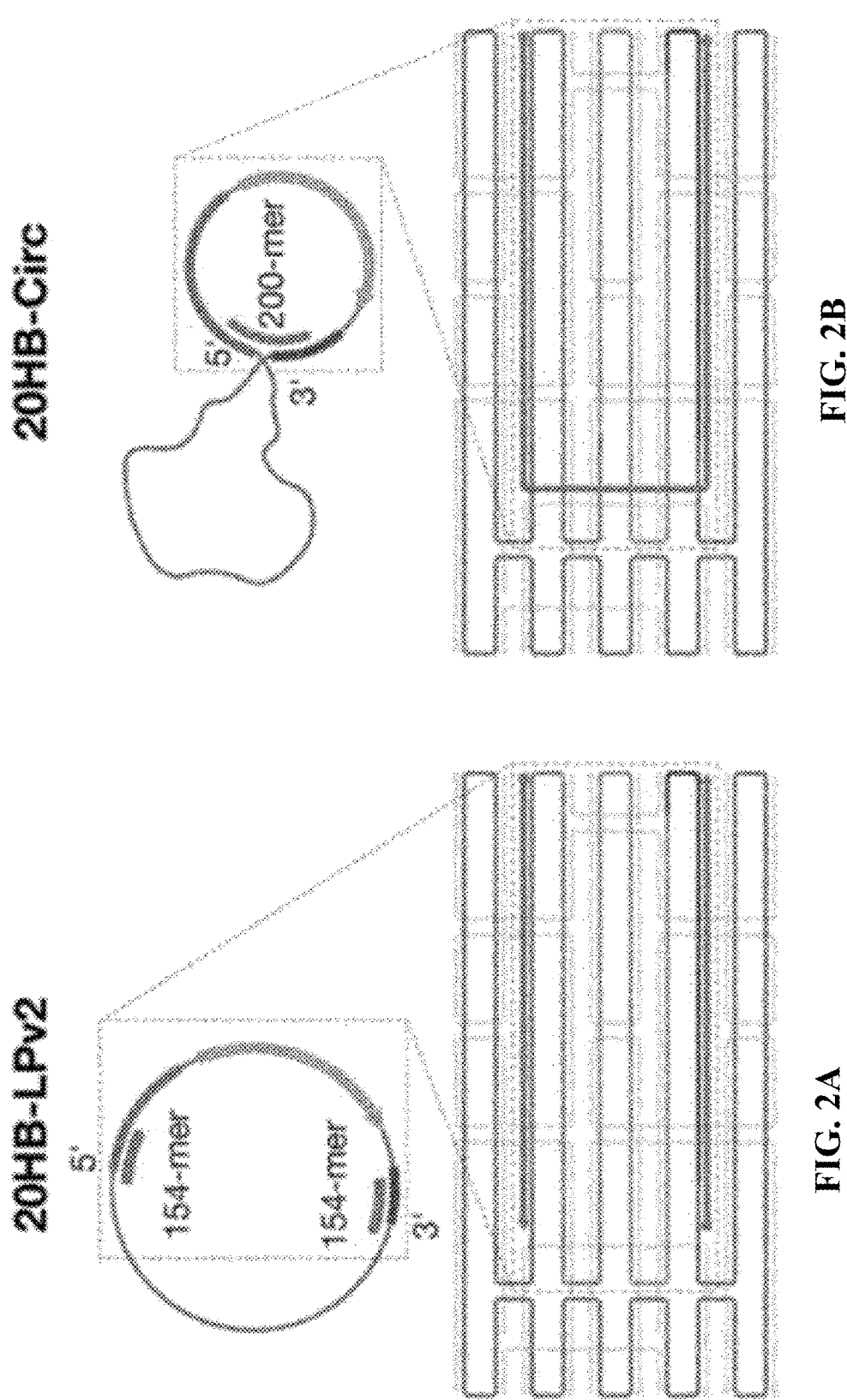
FIGS. 2A-2G show the optimization of gene expression through alternative staple design and scaffold orientation. Scaffold routing and schematic of unfolded scaffold for 20HB-LPv2 and 20HB-Circ designs, FIG. 2A and FIG. 2B respectively. 20HB-LPv2 incorporates two continuous 154-mer enhancer staples, and 20HB-Circ design has been routed so that the 200-mer enhancer staple, which acts as a splint to bring together the 5' start of the CMV, and the 3'.
Figure 2D:
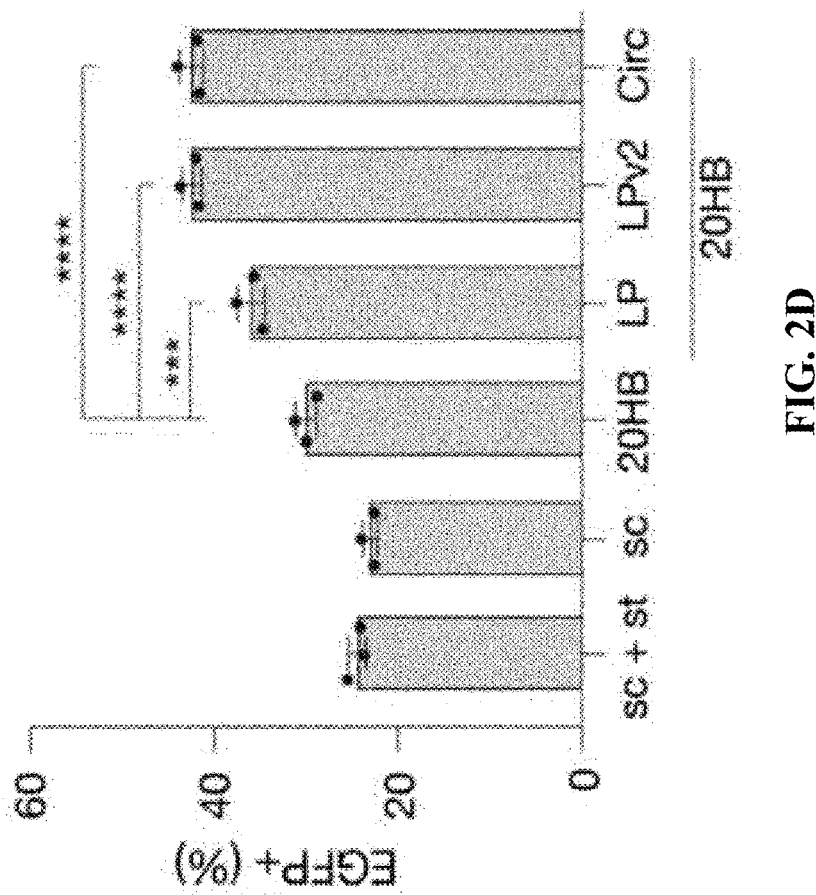
Figure 2C:
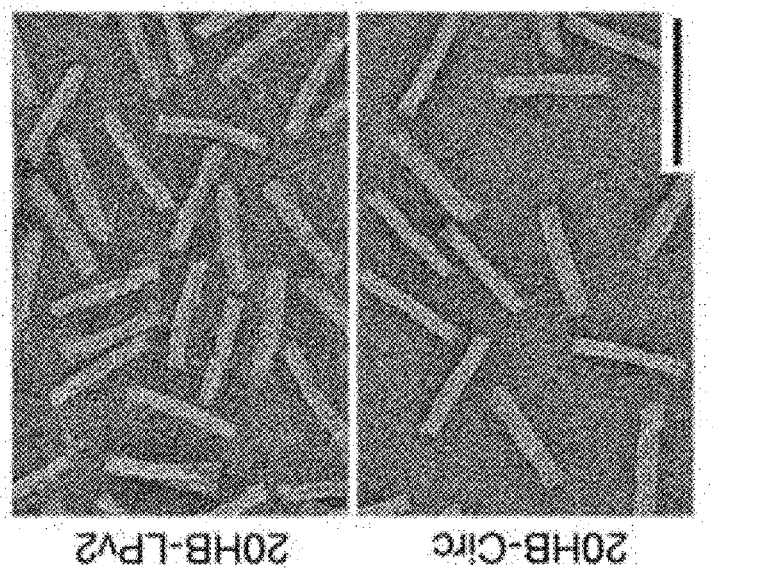

The inventors observed that electroporating a premixed, non-annealed cocktail of ssDNA scaffold and staple strands, which do not form structured objects, resulted in slightly higher transfection efficiency compared to administering the ssDNA scaffold alone (FIG. 1C, 1E). The inventors hypothesized that partial association occurs between the staple and scaffold strands, resulting in double-stranded DNA regions around the promoter regions that enhance gene expression. The inventors thus tested whether simply increasing the average staple length in a DNA origami object would lead to enhanced expression, which was not the case, suggesting that a more targeted design is required. We redesigned the 20HB object to incorporate long continuous staple segments (enhancer staples) with no crossovers in the promoter region, resulting in a structure with continuous 93-mer and 154-mer staples (enhancer staples) flanking the expression region and at the 5' start region of the CMV promoter, and at the 3' end of the polyA sequence (20HB-LP and 20HB-LPv2, respectively). A schematic of 20HB-LPv2 design and staple localization is given in FIG. 2A. Inspired by the partially double stranded hepatitis B genome[12], the inventors also prepared a design in which a 200-mer staple acts as a splint between the 5' start of the CMV, and the 3' end of the polyA to form a partially double stranded circular structure when unfolded (20HB-Circ) (FIG. 2b). All designs folded readily into defined 20HBs, as seen by direct imaging by TEM (FIG. 2C). Delivery of these objects into cells resulted in up to 50% enhancement of gene expression efficiency for objects 20HB-LP, 20HB-LPv2 and 20HB-Circ when compared to the standard 20HB staple routing (FIG. 2D).

Figure 2E:
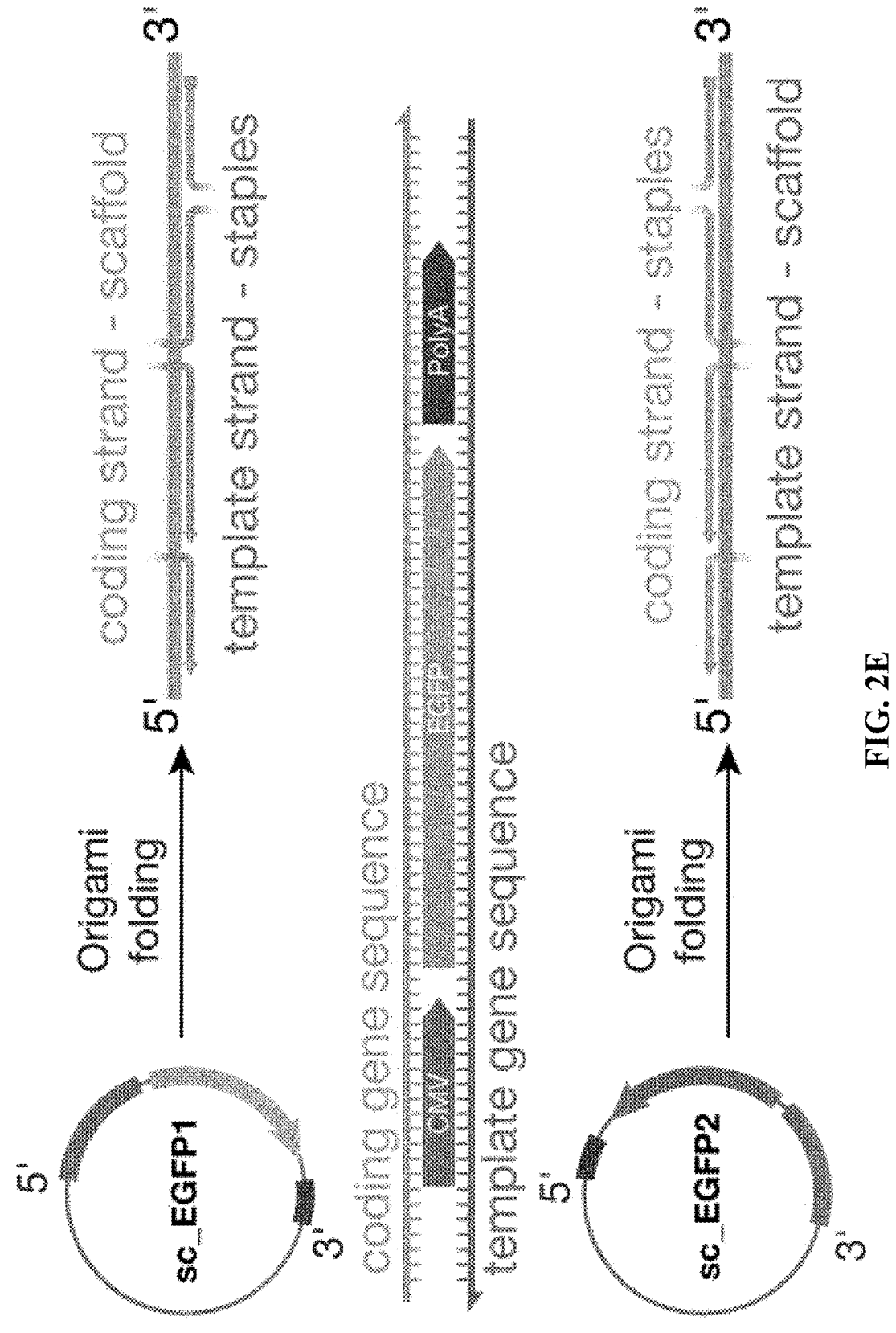
Figures 2F, 2G:
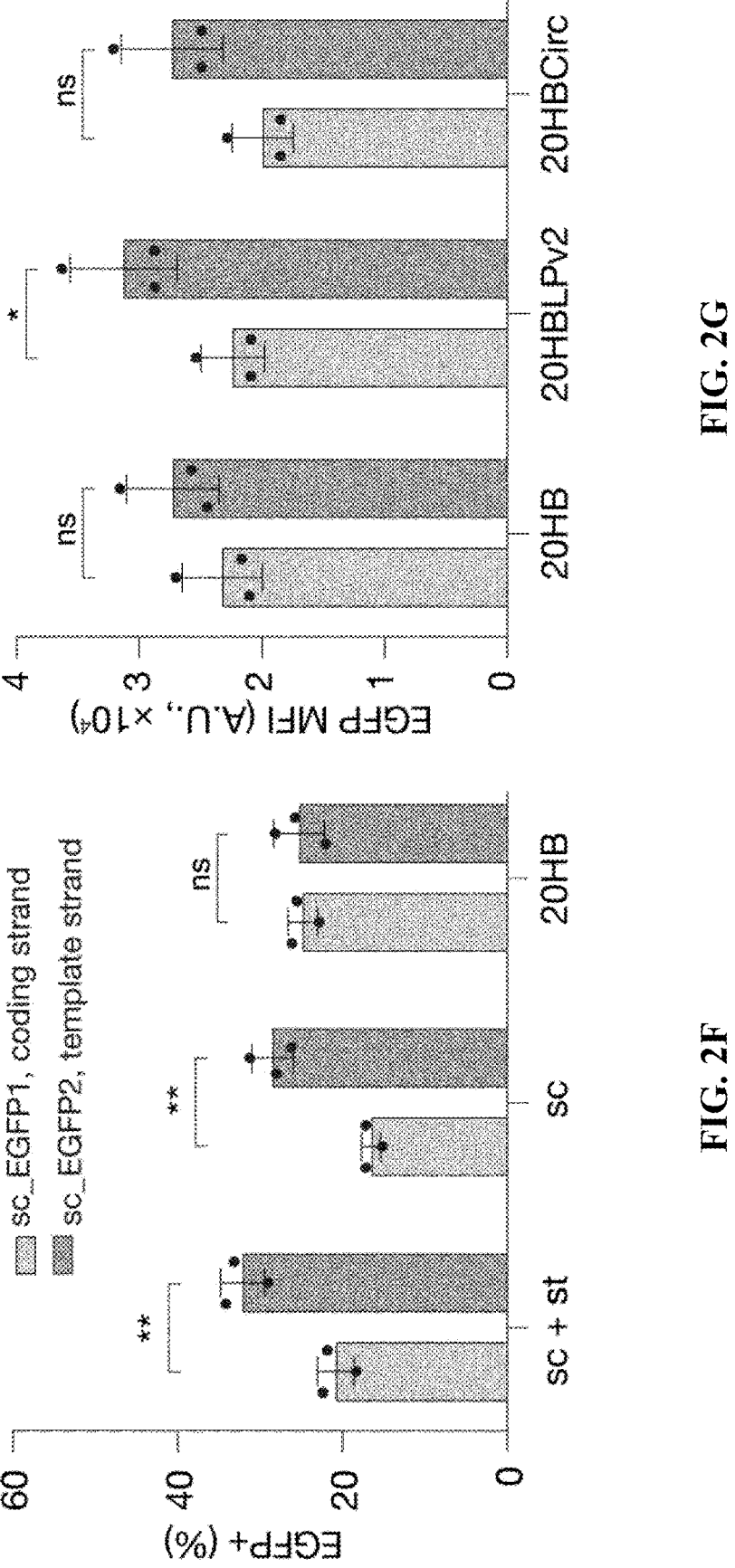

Next, the inventors determined whether the orientation of the target gene on the scaffold impacts gene expression. As the scaffold is ssDNA, delivery of the coding strand requires synthesis of the complementary sequence (template strand) prior to transcription. The inventors created a 'template strand' scaffold with the reverse complementary gene sequences (sc_EGFP2, FIG. 2E). Delivering these scaffolds with and without staples demonstrated significantly increased transfection efficiency for the template strand compared to the coding strand (FIG. 2F). However, when folded into the 20HB DNA origami object, the difference in transfection efficiency disappeared (FIG. 2F, right). The overall transfection efficiency of the 20HBs thus does not depend on having either the coding or template strand as the scaffold. Yet the inventors observed a minor trend of increased mean fluorescent intensity (MFI) of EGFP in EGFP-positive cells for all objects with the template-strand scaffold relative to those where the coding strand was used as scaffold (FIG. 2G).

Inclusion of Scaffold Sequence Features Boosts Gene Expression.

Figure 3A:
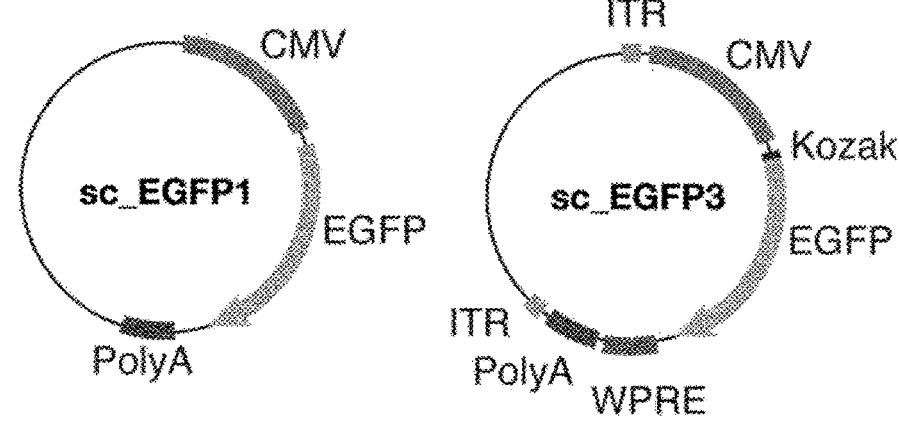
Figure 3A:
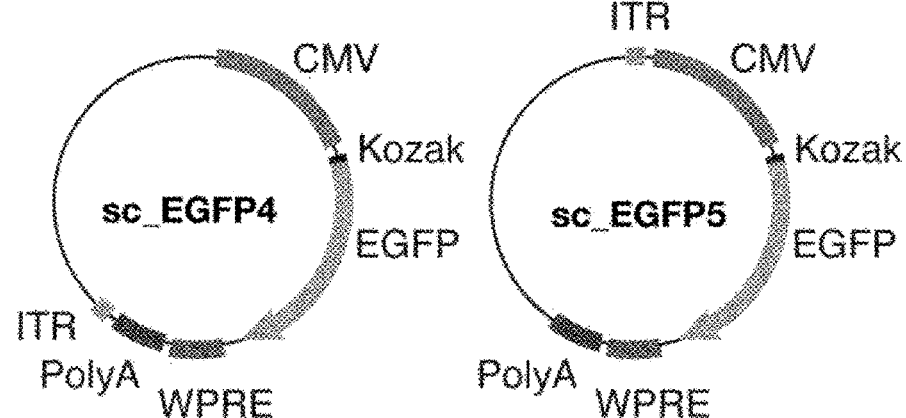
Figure 3A:
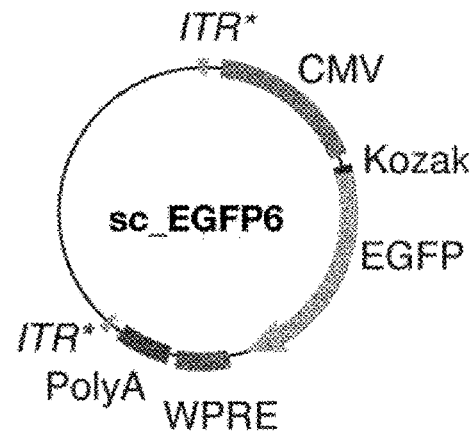

To further enhance the gene expression, the inventors included additional features in the scaffold sequence based on ssDNA AAV2 expression cassettes (FIG. 3A). The inventors placed a kozak sequence, which functions as a protein translation site,[13] upstream of EGFP; a chimeric intron, and a woodchuck hepatitis virus post-transcriptional regulatory element (WPRE) downstream of EGFP (before the polyA). The WPRE is thought to improve mRNA stability and protein yield.[14] Additionally, the inventors included inverted terminal repeats (ITRs) flanking the expression cassette. ITRs are palindromic sequences which form a T-shaped hairpin, and are used by adeno-associated viruses as an origin of replication for their ssDNA genome, in addition to other functions.[15,16] The inventors attempted producing a synthetic scaffold ssDNA containing all of these features (sc_EGFP3, FIG. 3A). The scaffold was produced at low yield and low quality, which the inventors attributed to the repetitive ITR structures. To improve scaffold yield and quality we produced a further series of scaffolds that included only a single ITR downstream or upstream of the expression cassette (sc_EGFP4 and sc_EGFP5, respectively). Additionally, the inventors created a scaffold which includes partial sequences of both ITRs, but where the ITR hairpin would be provided by a complementary staple oligonucleotide during DNA origami folding (sc_EGFP6). 20HBs with standard staple designs were produced for all these scaffold variants.

The inventors observed a trend of increased transfection efficiency and enhanced gene expression in the scaffold-only controls in all cases relative to the original sc_EGFP1 scaffold (FIG. 3B). The 20HB samples folded from the "enhanced" scaffolds demonstrated a similar range of transfection efficiencies relative to those observed for 20HB folded from the sc_EGFP1 scaffold but the MFI was significantly increased in the positive cells for 20HBs folded from the "enhanced" scaffolds sc_EGFP3/4/5/6 relative to the original sc_EGFP1 (FIG. 3B), meaning that the additional features in the scaffolds enhanced intracellular gene expression.

Figure 4A:
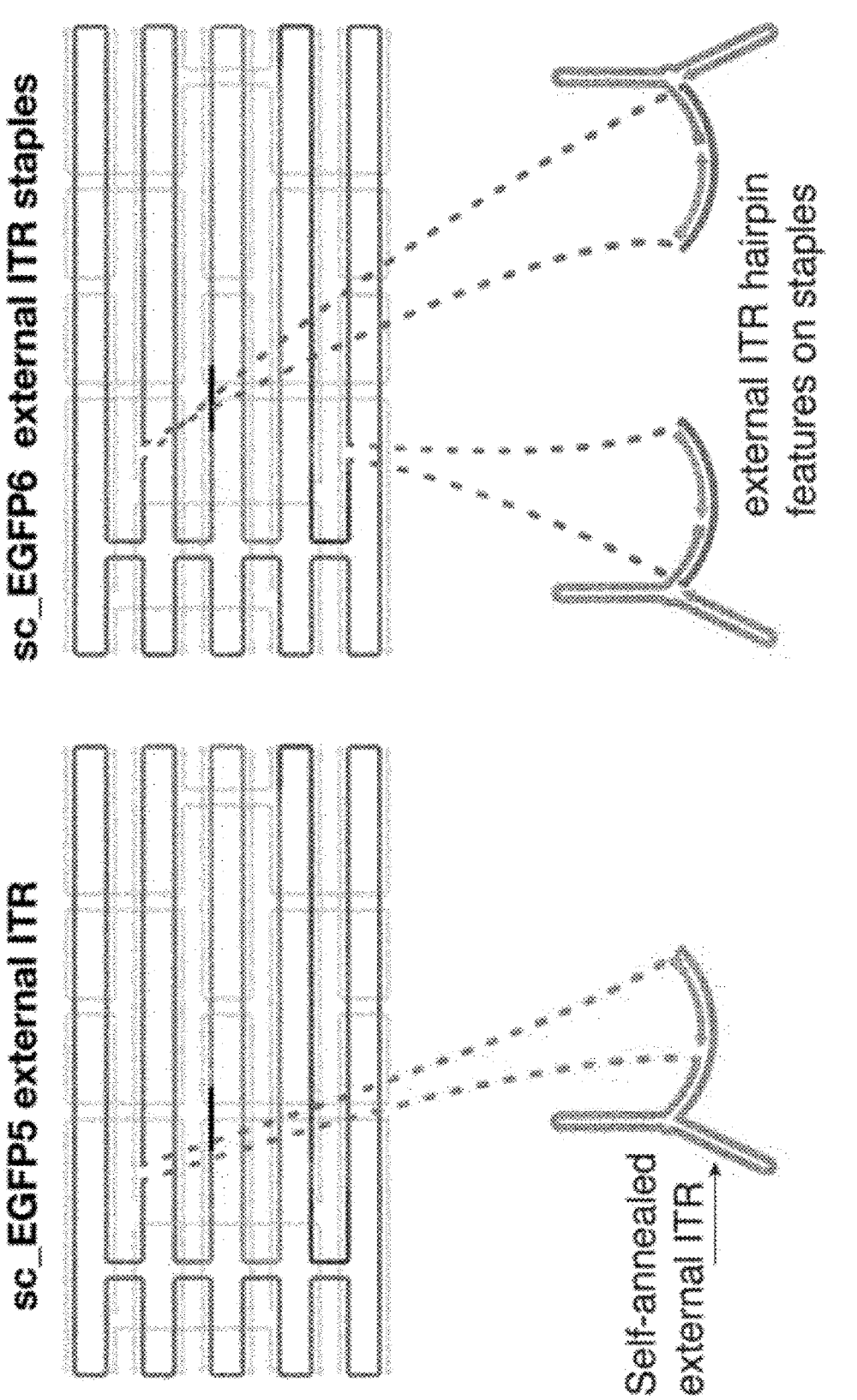

In the inventors designs discussed thus far, the ITR sequences were masked within double-helical DNA domains in the object, to become available only once the object denatures within the cell. The inventors hypothesized that the gene expression from the 20HB may be further improved by positioning the ITR sequence motif such that it can already assemble into its hairpin secondary structure during folding of the object (FIG. 4A, design 20HB-ex). Additionally, the inventors included a continuous 154-mer staple (enhancer staple) at the 5' region of the promoter for design 20HB-exLP, encoded with both sc_EGFP5 and 6 scaffolds. Indeed, delivery of these designs demonstrated up to 2-fold transfection enhancement (FIG. 4B) and up 6-fold and 9-fold increased expression efficiency, respectively, as measured by MFI (FIG. 4C, 4D) compared to the original 20HB design using the sc_EGFP1 scaffold.

Figure 5A:
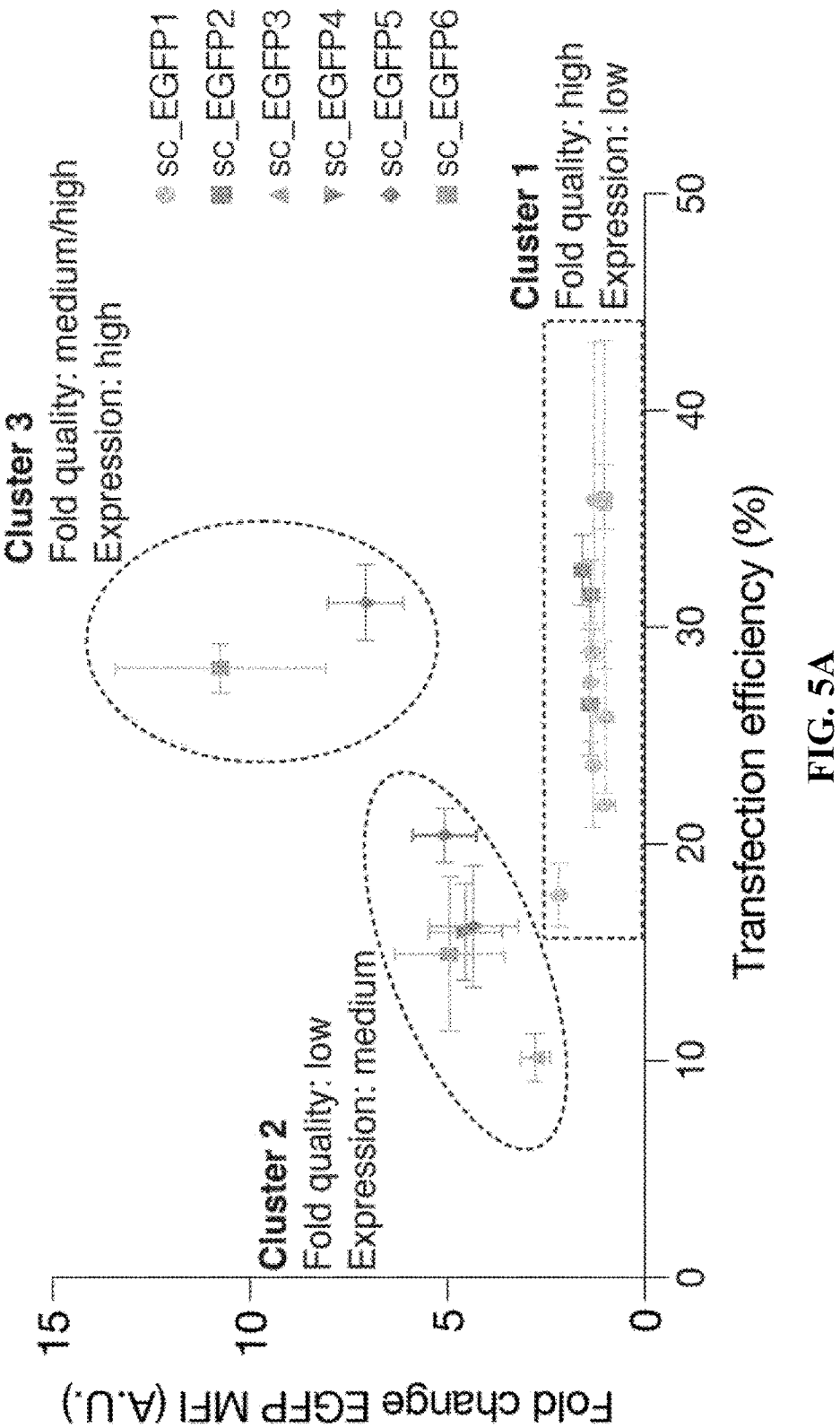
FIGS. 5A-5B show structure transfection summary and optimization.
Figure 5B:
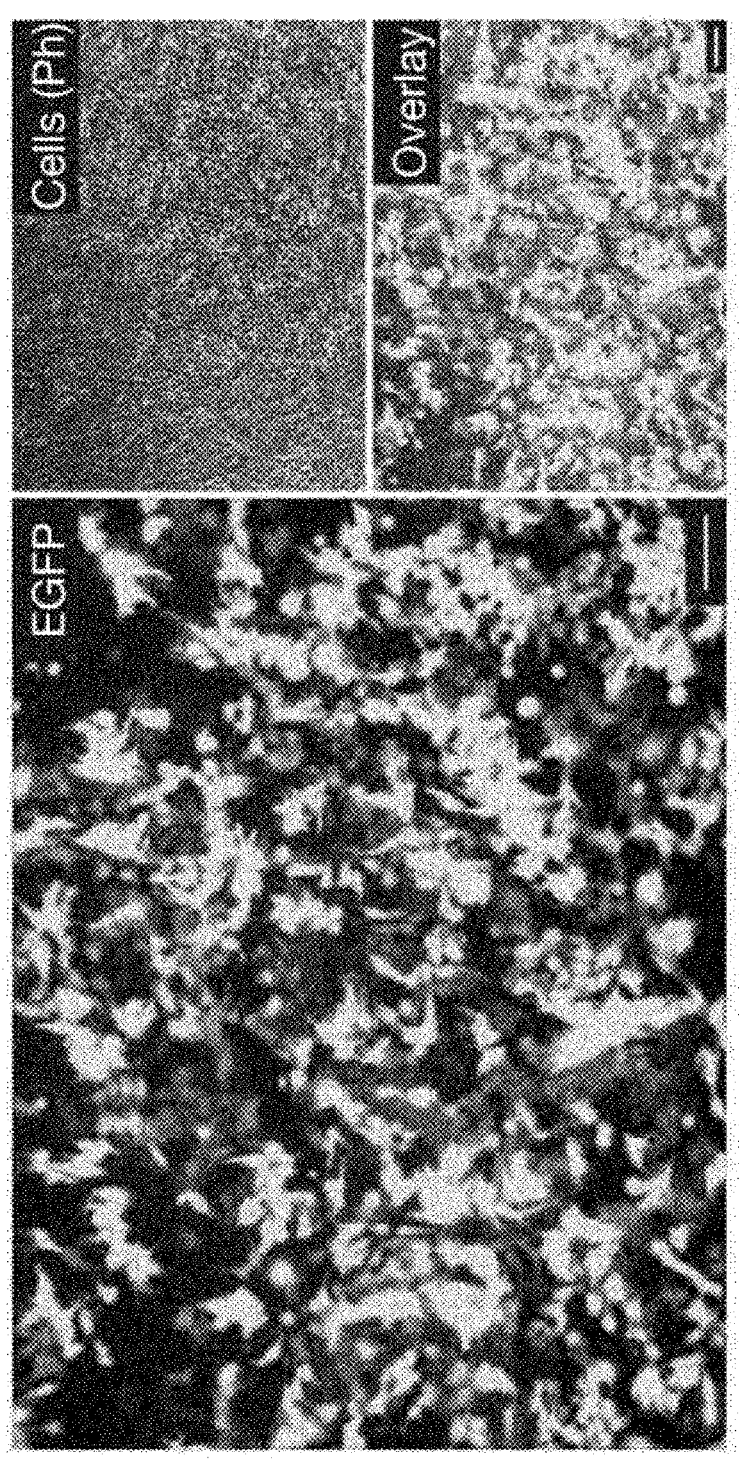

The inventors plotted the transfection efficiency achieved against the fold-change EGFP MFI (A.U.) for all designs, relative to the sc_EGFP1 20HB-ext as an internal control (FIG. 5A). The samples separate into three clusters. Cluster 1 includes objects built from sc_EGFP1/2 scaffolds, which have a high quality of folding and high transfection efficiencies, but featured low overall gene expression. Cluster 2 includes objects based on sc_EGFP3/4/5/6 scaffolds which had low quality of folding and low transfection efficiencies but enhanced gene expression. Cluster 3 then had objects with improved folding quality, as is the case with 20HB-exLP for sc_EGFP5 and 6 scaffolds, and improved transfection efficiency and improved gene expression. Finally, the inventors further optimized the transfection efficiency by titrating the amount of material administered and by varying the electroporation conditions, resulting in even higher transfection efficiencies (~80%) and MFIs (FIG. 5B).

Encoding Active Nuclear Import into DNA Origami

Figure 6:
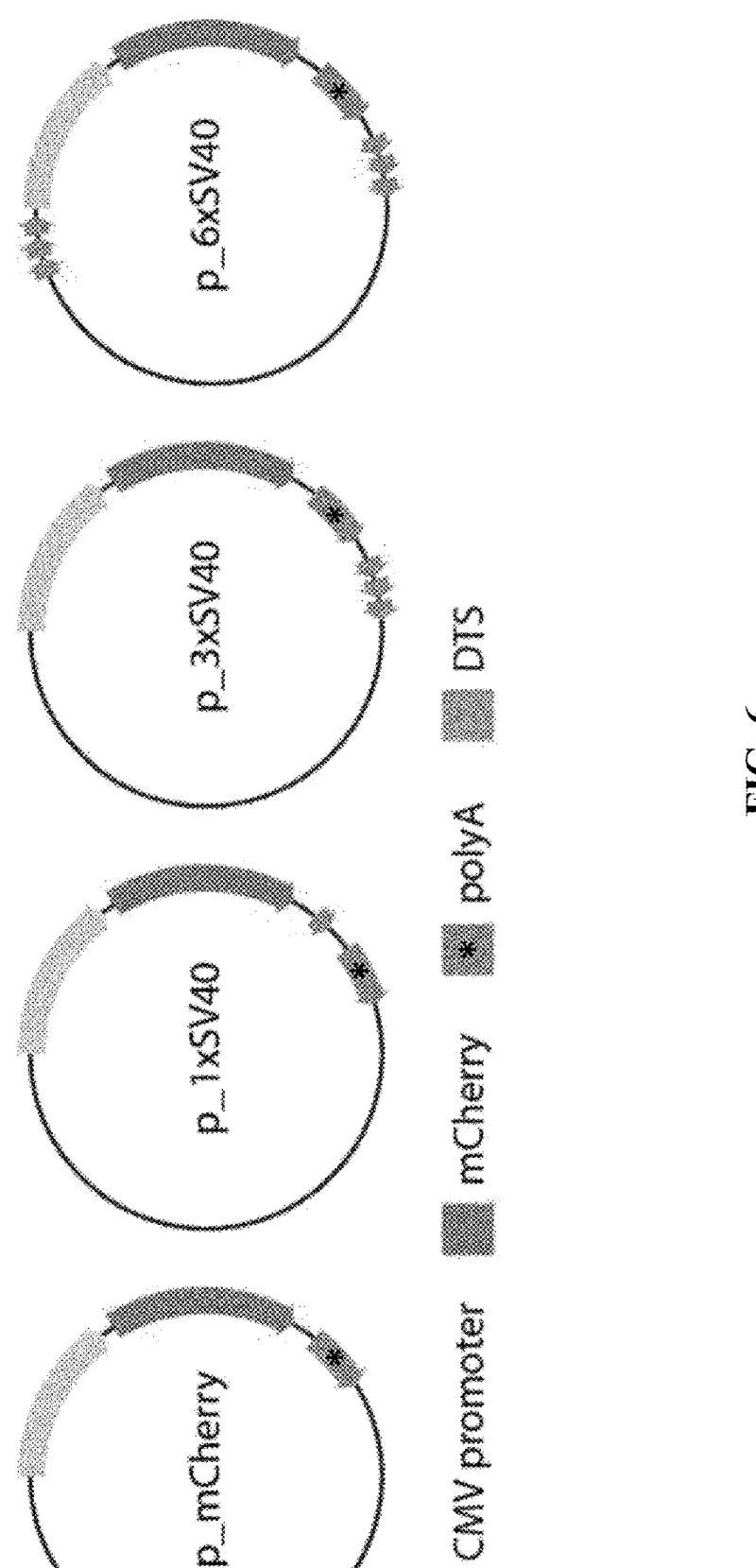
FIG. 6 shows plasmid designs with varying numbers of SV40 DTS sequences included (0×, 1×, 3× and 6×SV40 repeats) for production of custom scaffolds.

The inventors designed and investigated DNA origami objects inherently encoded with instructions for active nuclear import within mammalian cells using a mCherry gene expression cassette to enable easy fluorescent read-out to assess successful nuclear access (FIG. 6). The inventors designed DNA origami scaffolds to encode for mCherry expression and DNA nuclear targeting sequences (DTS) within the origami structures. The custom ssDNA scaffold was designed to include a CMV promoter, mCherry reporter gene, and a polyA signal, to be encoded in the 5' to 3' direction (coding strand). The inventors chose to use the 72 bp Simian virus 40 (SV40) DTS[17], and incorporated either 0×, 1×, 3× or 6×SV40 repeats into the scaffold design (FIG. 6). The inventors designed a 20-helix bundle (20HB) and orientated the scaffold so that the gene features and DTS sequences are on the exterior helices of the objects.

Figures 7A, 7B:
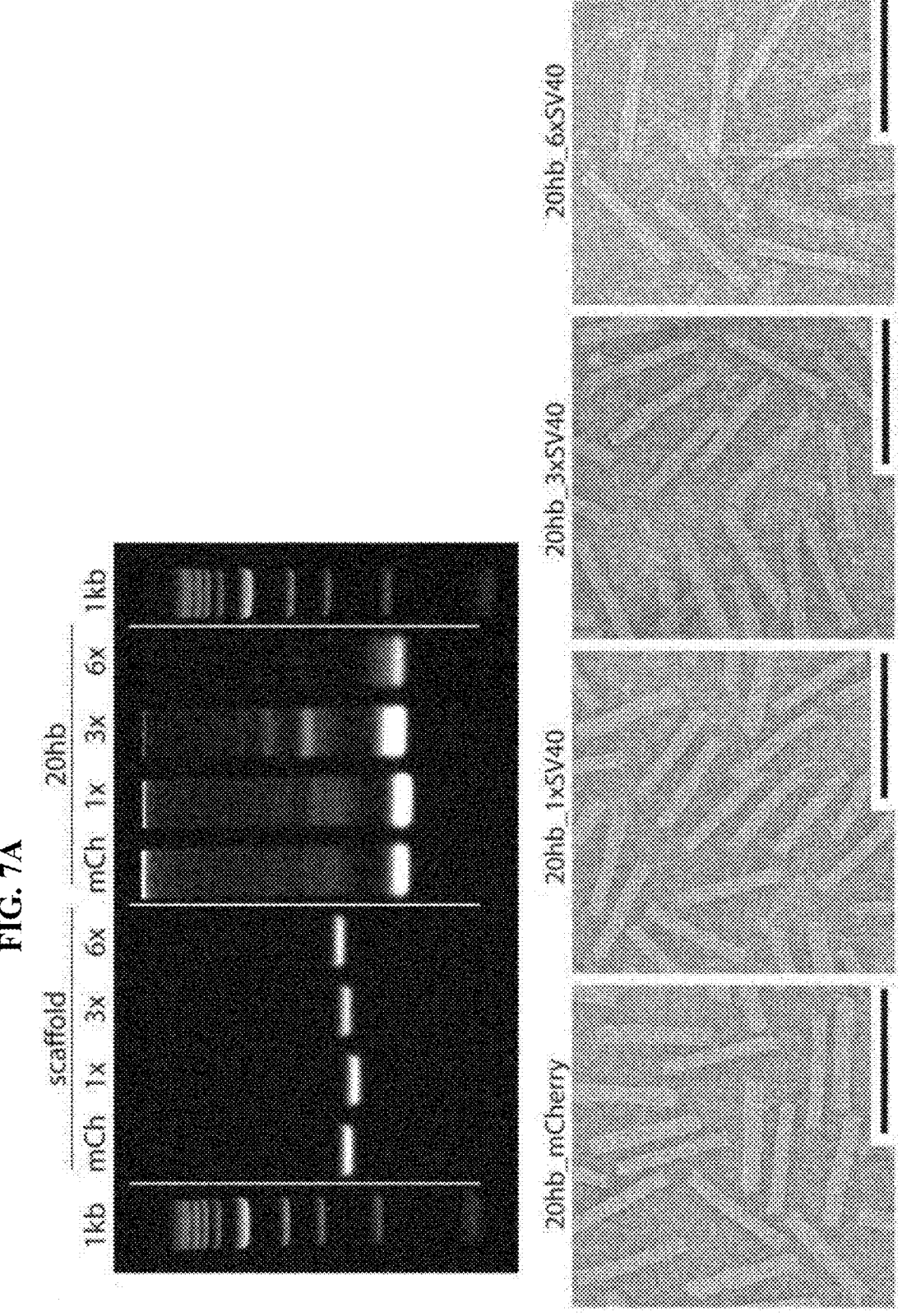
FIGS. 7A-7B show production and characterization of custom scaffolds and corresponding DNA origami structures.

Four DNA origami structures, corresponding to each of the custom scaffolds, were folded and purified. The 20HB-mCh and 20HB-1×SV40 folded at high yield with a clear leading band and without major structure impurities, while 20HB-3×SV40 and 20HB-6×SV40 displayed some structural impurities (FIG. 7). The 20HB-3×SV40 structure demonstrated low level presence of higher order bands. The higher order impurities were even more prominent within the 20HB-6×SV40 object and so this object was further gel purified. The inventors attribute the difficulty in folding to the increasing number of repetitive DTS sequences in the scaffold impeding the folding.

Figures 8A, 8B, 8C, 8D:
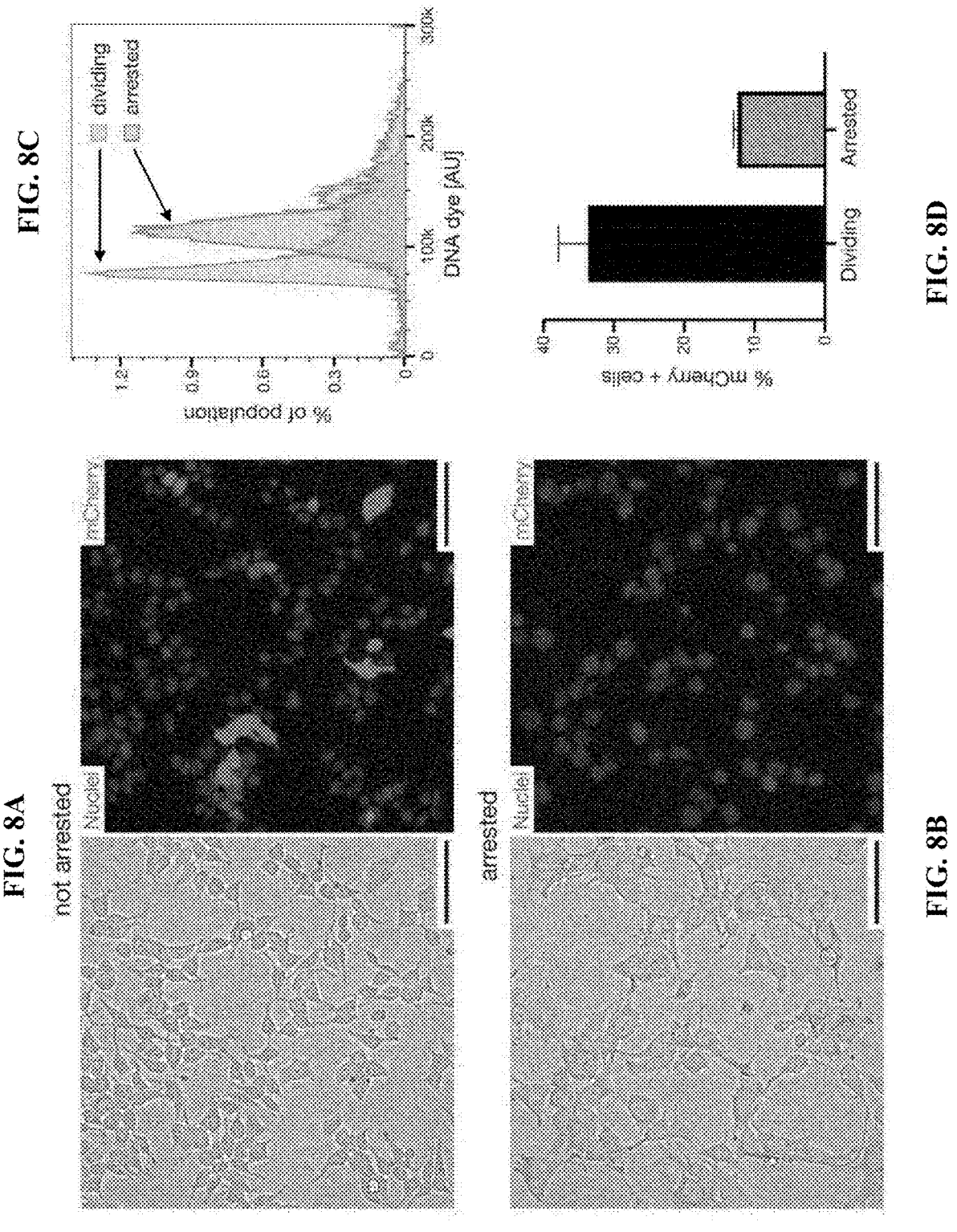
FIGS. 8A-8D show that cell cycle arrest diminishes gene delivery efficiency. Representative transmission image and corresponding fluorescence image of dividing FIG. 8A and arrested FIG. 8B HEK293T cells 24 h after electroporation with the 20HB-mCh without any SV40 sequences, scale bar 100 μm.
Figures 9A, 9B:
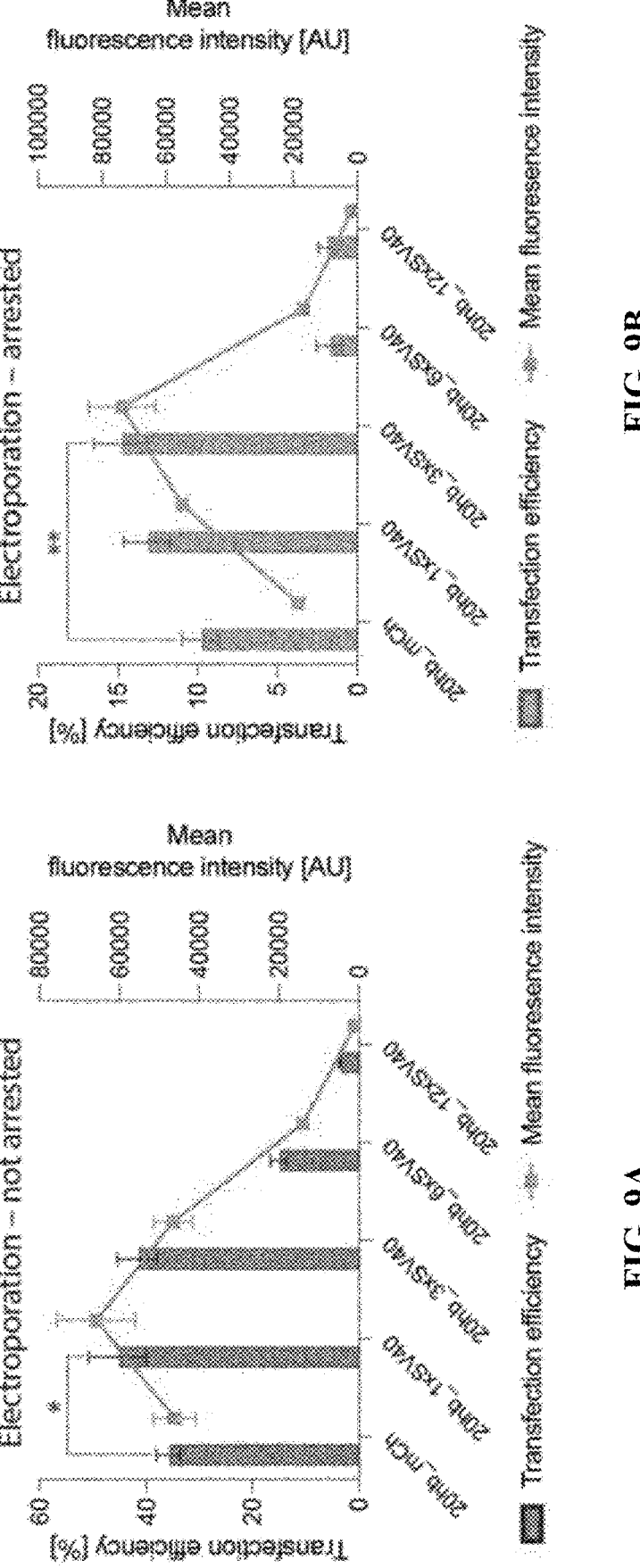
FIGS. 9A-9B show the effect of including SV40 DTS sequences in DNA origami structures on the gene expression in dividing and arrested HEK293T cells after electroporation.

The inventors were interested in both dividing cells, and cells arrested at the G1/S phases in the cell cycle to avoid passive nuclear uptake during mitosis. The inventors tested whether the cell cycle arrest leads to the expected decrease in gene expression, as it should inhibit occurrence of passive nuclear transport. For this purpose, the inventors transfected both dividing and arrested cells with the 20HB-mCh via electroporation. Cells were analyzed qualitatively by fluorescence microscopy and quantified by flow cytometry. The inventors observed a statistically significant decrease in the percentage of mCherry+ cells after electroporation in the arrested cell population (FIG. 8). Next, the 20HB variants, 20HB-mCh, 20HB-1×SV40, 20HB-3×SV40 and 20HB-6× SV40 were tested in both in dividing and chemically arrested HEK293T. Cells were quantitatively assessed via flow cytometry for proportion of mCherry+ cells (%) and MFI (A.U.) to signify gene expression levels, and values were compared to the control, 20HB-mCh (FIG. 9). In dividing cells, the inventors observed a slight increase in both the percentage of mCherry+ cells and the MFI for both 20HB-1×SV40 and 20HB-3×SV40. Inclusion of the SV40 DTS sequences had a greater effect in arrested cells, where the percentage of mCherry+ cells increased for the 20HB-1×SV40 (~1.4-fold), and even further for the 20HB-3×SV40 (~1.8-fold), when compared to 20HB-mCh. The MFI showed a similar trend with a 3-fold increase for the
20HB-1×SV40 and 4.5-fold increase for 20HB-3×SV40 in
chemically arrested cells. Interestingly, 20HB-6×SV40 dem-
onstrated consistently lower proportions of mCherry+ cells
and MFI of mCherry expression. The inventors attribute this
observation to the lower folding quality of the sample.
Multiplexed Gene Assemblies for Cotransfection.

Figures 10A, 10B:
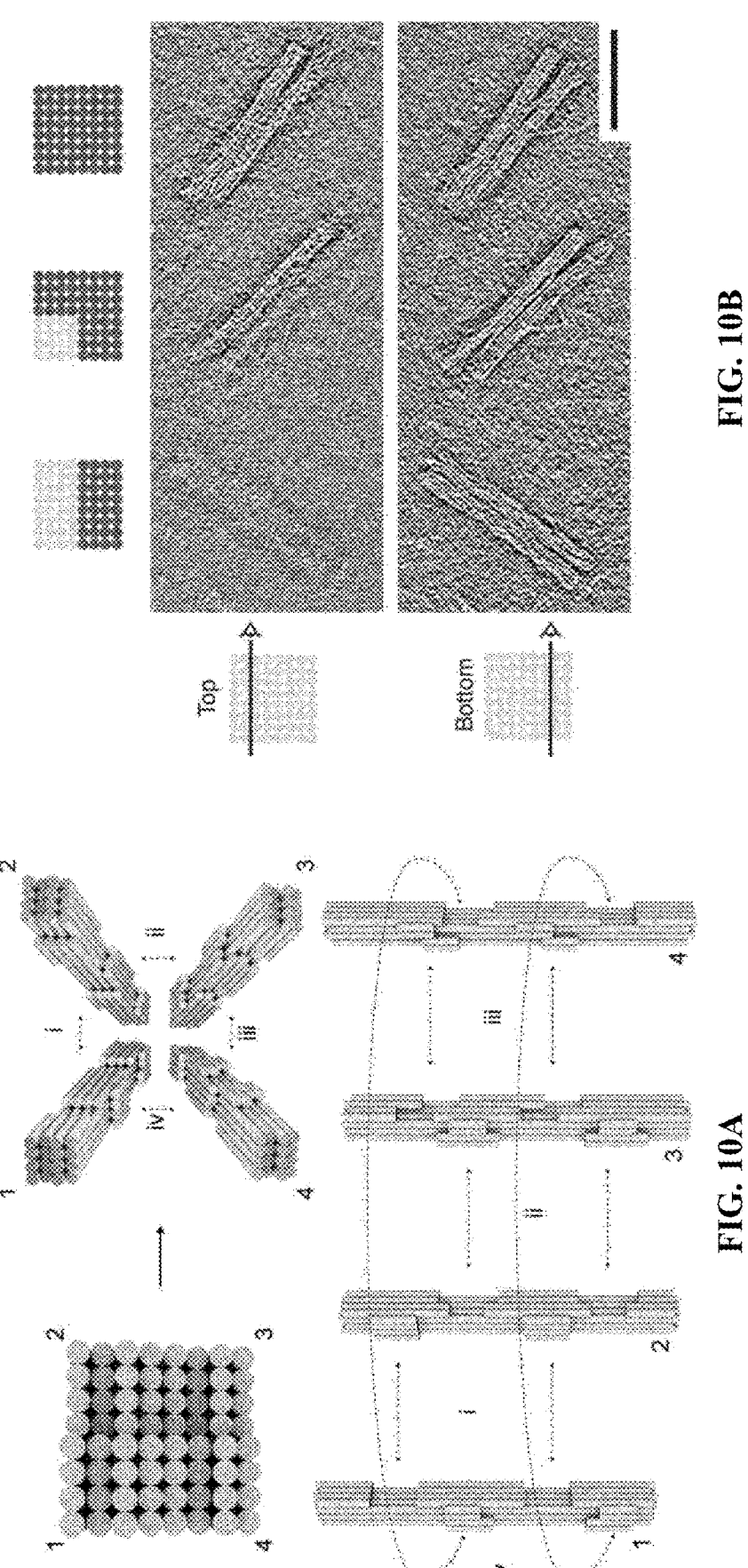
FIGS. 10A-10F show delivery of multimeric origami assemblies enables codelivery of genes in defined ratios.
Figure 10D:
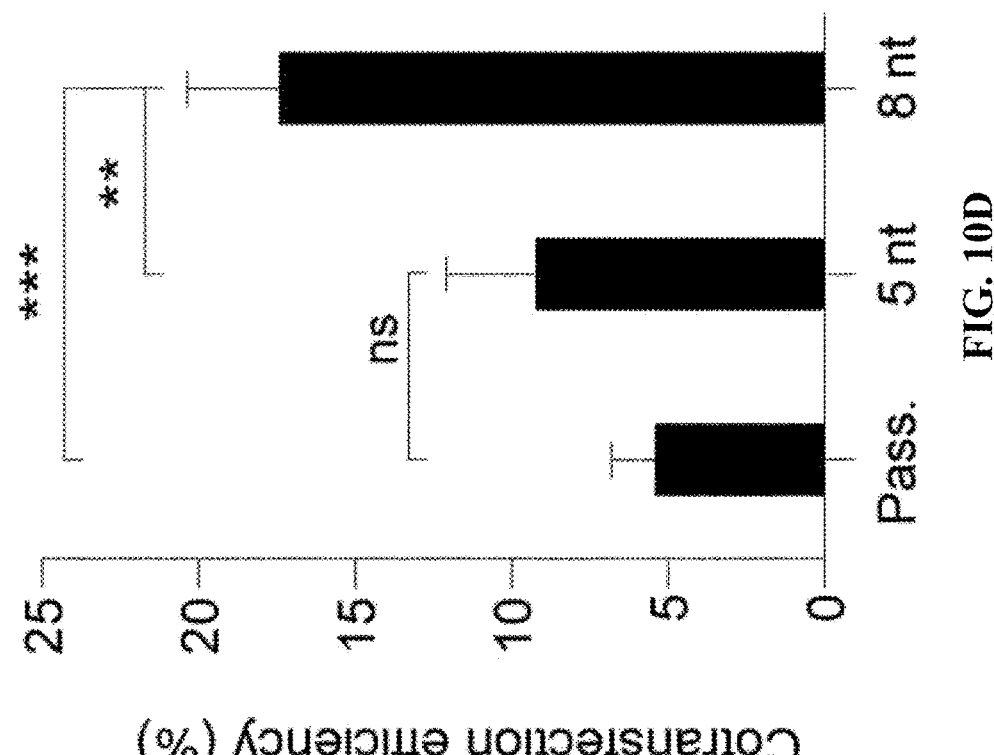
Figure 10C:
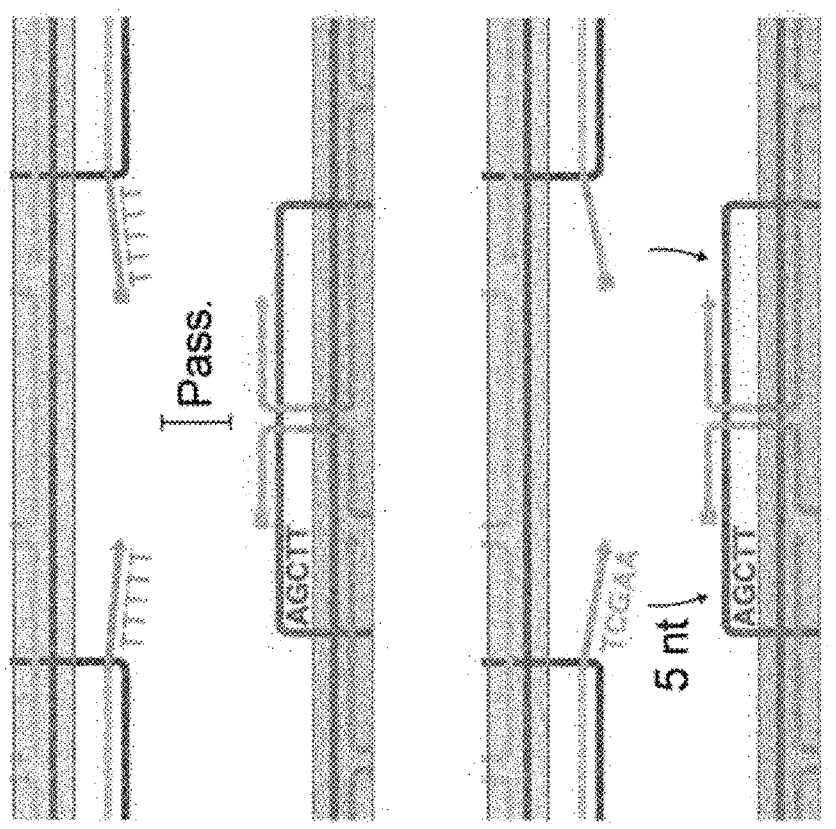
Figures 10E, 10F:
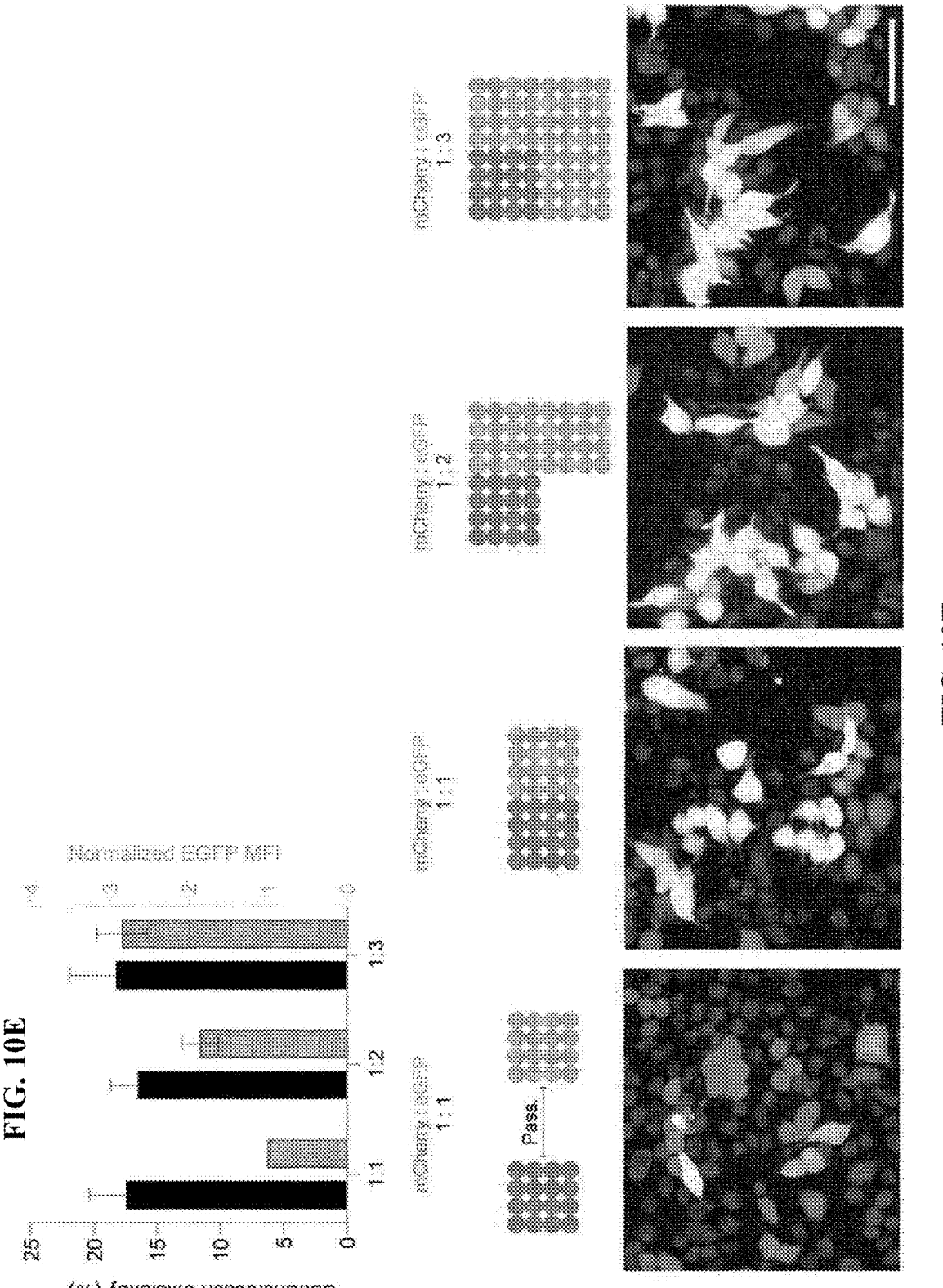
Figure 11A:
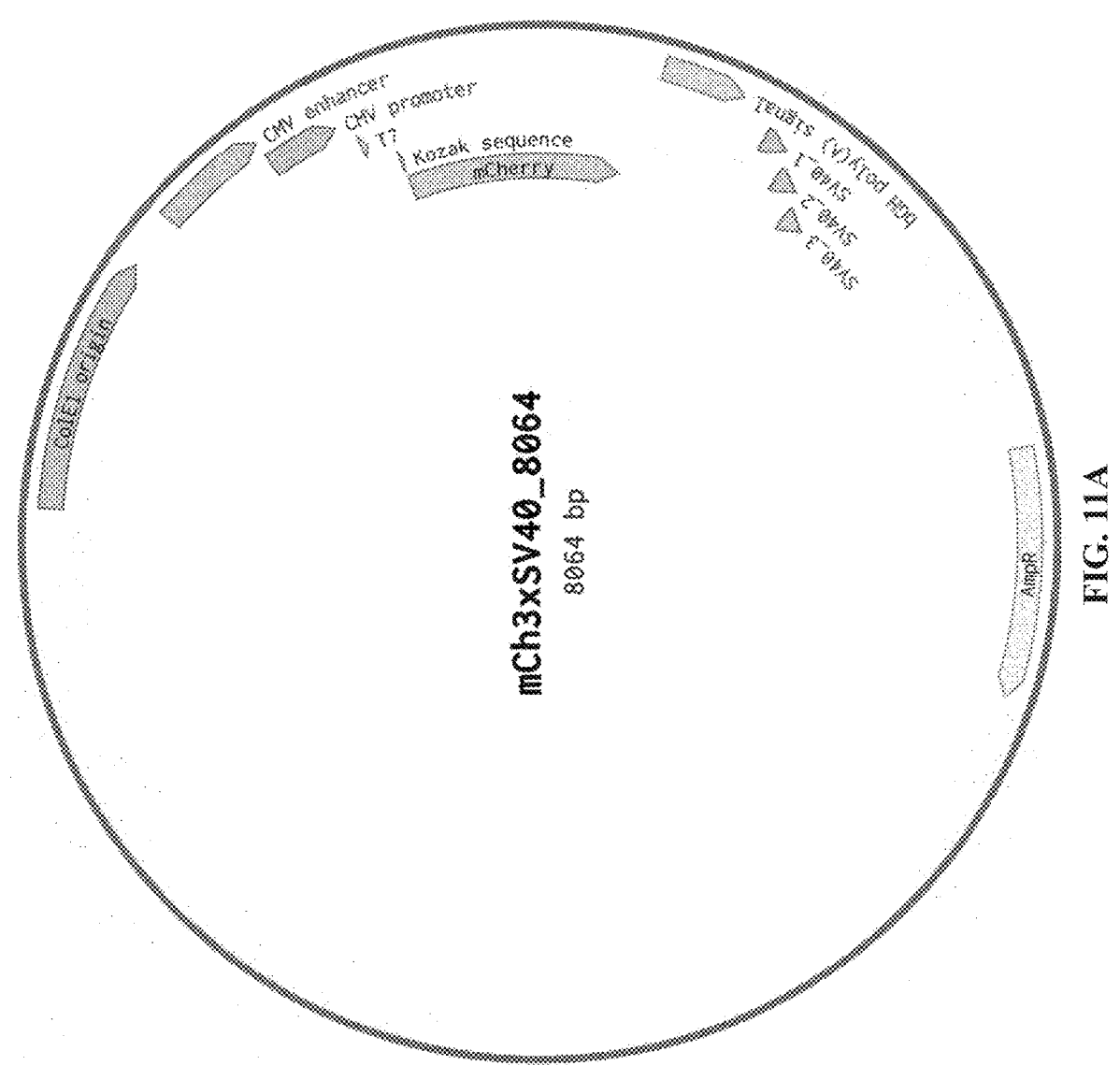
FIGS. 11A-11C show DNA origami triangles for gene expression.
Figure 11C:
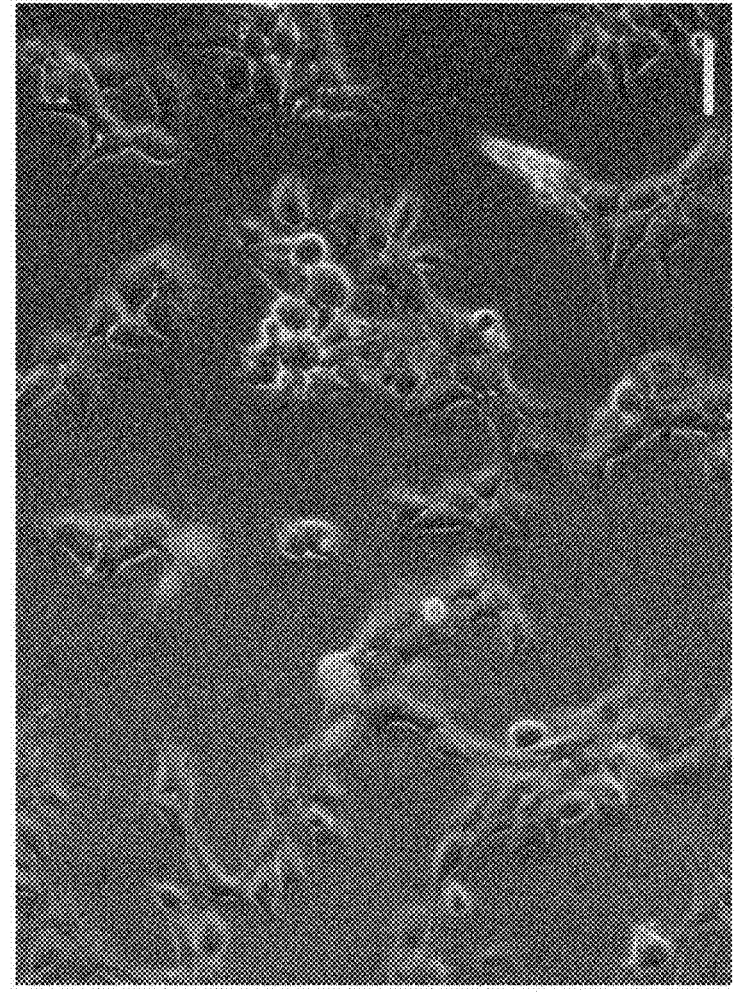
Figure 11B:
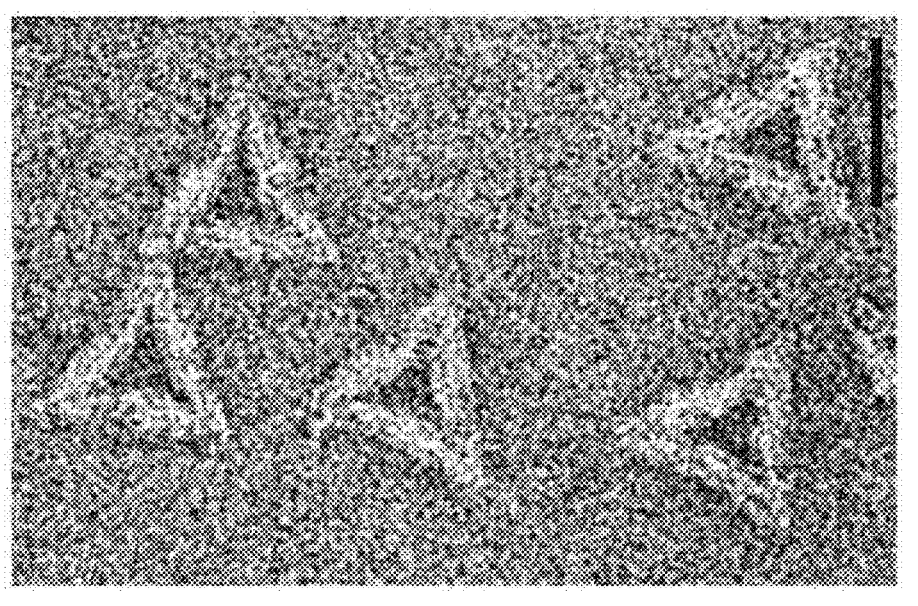

The inventors designed DNA origami objects encoding
for either mCherry or EGFP expression to enable assembly
and delivery in stoichiometric ratios of 1:1, 1:2 and 1:3
mCherry to EGFP (FIG. 10A, 10B, using scaffolds
sc_mCherry5 and sc_EGFP5). The individual gene blocks
were programmed to interact with each other via shape-
complementary docking sites[18] lined with sequence-comple-
mentary sticky-ends which were either five or eight base
pairs long (referred to as 5 nt or 8 nt sticky ends, respec-
tively). The inventors also made control objects that had
deactivated docking sites passivated with five thymidine
long single-strand overhangs (FIG. 10C). Gene assemblies
of either dimer, trimer or tetramers formed as designed, as
we saw by negative-staining TEM tomography and AGE
(FIG. 10B). The cotransfection efficiency for a 1:1 stoichio-
metric mixture of non-connected mCherry and EGFP mono-
mers was ~5.4+/−1.4%. By contrast, the inventors observed
~17.5+/−2.9% cotransfection efficiency when using a pre-
assembled dimer object that included both mCherry and
EGFP as expressible genes (FIG. 10D, 10F). The near-four-
fold increase in cotransfection relative to when delivering
the genes in separate objects indicates that the delivery and
expression of both components is now linked, and no longer
occurs at random.

Finally, the inventors delivered the multimeric origami
objects in the form of a dimer, trimer and tetramer with the
ratios of 1:1, 1:2 and 1:3 mCherry:EGFP. The molar con-
centration of the multimeric origami objects was conserved
across samples and the total cotransfection efficiency thus
remained comparable (FIG. 10E). However, the expression
level of EGFP was directly proportional to the number of
monomers present within the object (FIG. 10E). Direct
imaging of cells using two-channel fluorescence microscopy
agreed with the observations made in flow cytometry (FIG.
10f). Therefore, the inventors succeeded delivering and
expressing genes in a designed, stoichiometric ratio simply
by "clicking" the genes together in a higher-order DNA
origami assembly.

Example 5: Discussion

Here the inventors have investigated gene expression
from encoded DNA origami structures. The inventors pres-
ent scaffold and structural design features allowing for
highly efficient gene expression. The nanostructures of the
invention are highly effective tools for therapeutic gene
delivery applications. In addition to the electroporation
described above, the nanostructures of the invention can be
delivered using techniques other than electroporation, e.g.
techniques that enable even further optimization of trans-
fection efficiency and gene expression. Instead or in addition
to electroporation, inclusion of chemical moieties, aptamers,
peptides or antibodies on the origami surface can be used for
targeted delivery and gene expression. The nanostructures of
the invention are highly valuable for therapeutic applica-
tions, for example comprising designing scaffolds with the
inclusion of sequences encoding for expression of therapeu-
tic proteins, or gene-editing technology such as CRISPR-
Cas allows for therapeutic gene delivery and vaccines.
Furthermore, the inventions provides a valuable tool for probing the intracellular, or in vivo fate, of DNA nanotech-
nology which has, to date, proved to be difficult due to the
attachment of tracking molecules being largely on the
staples, rather than the scaffold.

Example 6: Exemplary Sequences

SEQ ID NOs 1-11: Scaffold Sequences
Sequences of scaffolds sc_EGFP1 (SEQ ID NO 1);
sc_EGFP2 (SEQ ID NO 2); sc_EGFP3 (SEQ ID NO 3);
sc_EGFP4 (SEQ ID NO 4); sc_EGFP5 (SEQ ID NO 5);
sc_EGFP6 (SEQ ID NO 6), sc_mCherry5 (SEQ ID NO 7);
sc_mCherry (SEQ ID NO 8); sc_mCherry_1×SV40 (SEQ
ID NO 9); sc_mCherry_3×SV40 (SEQ ID NO 10); and
sc_mCherry_6×SV40 (SEQ ID NO 11).
SEQ ID NOs 12-21: Specific Features
Sequences of CMV promoter/enhancer (SEQ ID NO 12),
5' ITR (SEQ ID NO 13), 3' ITR (SEQ ID NO 14), Chimeric
Intron (SEQ ID NO 15), Kozac (SEQ ID NO 16), WPRE
(SEQ ID NO 17), EGFP (SEQ ID NO 18), bGH polyA (SEQ
ID NO 19), mCherry (SEQ ID NO 20), and SV40 (SEQ ID
NO 21).
SEQ ID NOs 22-75: Primer Sequences (See Also Table 1).
SEQ ID NOs 76-1507: Exemplary staple strand sequences
SEQ ID NOs 76-177: Staple sequences for sc_EGFP1;
20HB-ext.
SEQ ID NOs 178-279: Staple sequences for sc_EGFP1;
20HB-ext-W.
SEQ ID NOs 280-381: Staple sequences for sc_EGFP1;
20HB-int.
SEQ ID NOs 382-483: Staple sequences for sc_EGFP1;
20HB-int-W.
SEQ ID NOs 484-584: Staple sequences for sc_EGFP1;
32HB.
SEQ ID NOs 585-692: Staple sequences for sc_EGFP1;
12HB.
SEQ ID NOs 693-766: Staple sequences for sc_EGFP1;
20HB-LS.
SEQ ID NOs 767-863: Staple sequences for sc_EGFP1;
20HB-LP.
SEQ ID NOs 864-957: Staple sequences for sc_EGFP1;
20HB-LPv2.
SEQ ID NOs 958-1055: Staple sequences for sc_EGFP1;
20HB-Circ.
SEQ ID NOs 1056-1157: Staple sequences for
sc_EGFP2; 20HB.
SEQ ID NOs 1158-1279: Staple sequences for
sc_EGFP3; 20HB.
SEQ ID NOs 1280-1392: Staple sequences for
sc_EGFP4; 20HB.
SEQ ID NOs 1393-1507: Staple sequences for
sc_EGFP5; 20HB-exLP.

REFERENCES

1. Engelhardt, F. A. S. et al. Custom-Size, Functional, and
Durable DNA Origami with Design-Specific Scaffolds.
*ACS Nano* 13, 5015-5027 (2019).
2. Praetorius, F. et al. Biotechnological mass production of
DNA origami. *Nature* 552, 84-87 (2017).
3. Stahl, E., Martin, T. G., Praetorius, F. & Dietz, H. Facile
and Scalable Preparation of Pure and Dense DNA Ori-
gami Solutions. *Angewandte Chemie* 126, 12949-12954
(2014).
4. Wagenbauer, K. F. et al. How We Make DNA Origami.
*Chem Bio Chem* 18, 1873-1885 (2017).

5. Schindelin, J. et al. Fiji: an open-source platform for biological-image analysis. *Nat Methods* 9, 676-682 (2012).
6. Kremer, J. R., Mastronarde, D. N. & McIntosh, J. R. Computer Visualization of Three-Dimensional Image Data Using IMOD. *Journal of Structural Biology* 116, 71-76 (1996).
7. Bastings, M. M. C. et al. Modulation of the Cellular Uptake of DNA Origami through Control over Mass and Shape. *Nano Lett.* 18, 3557-3564 (2018).
8. Wang, P. et al. Visualization of the Cellular Uptake and Trafficking of DNA Origami Nanostructures in Cancer Cells. *J. Am. Chem. Soc.* 140, 2478-2484 (2018).
9. Gerling, T., Kube, M., Kick, B. & Dietz, H. Sequence-programmable covalent bonding of designed DNA assemblies. *Science Advances* (2018).
10. Mitchell, D. L., Vaughan, J. E. & Nairn, R. S. Inhibition of transient gene expression in Chinese hamster ovary cells by cyclobutane dimers and (6-4) photoproducts in transfected ultraviolet-irradiated plasmid DNA. *Plasmid* 21, 21-30 (1989).
11. Jiang, Y., Ke, C., Mieczkowski, P. A. & Marszalek, P. E. Detecting Ultraviolet Damage in Single DNA Molecules by Atomic Force Microscopy. *Biophys J* 93, 1758-1767 (2007).
12. Wei, L. & Ploss, A. Hepatitis B virus cccDNA is formed through distinct repair processes of each strand. *Nat Commun* 12, 1591 (2021).
13. Acevedo, J. M., Hoermann, B., Schlimbach, T. & Teleman, A. A. Changes in global translation elongation or initiation rates shape the proteome via the Kozak sequence. *Sci Rep* 8, 4018 (2018).
14. Brun, S., Faucon-Biguet, N. & Mallet, J. Optimization of transgene expression at the posttranscriptional level in neural cells: implications for gene therapy. *Molecular Therapy* 7, 782-789 (2003).
15. Ping, H., Liu, X., Zhu, D., Li, T. & Zhang, C. Construction and Gene Expression Analysis of a Single-Stranded DNA Minivector Based on an Inverted Terminal Repeat of Adeno-Associated Virus. *Mol Biotechnol* 57, 382-390 (2015).
16. Cao, L., During, M. & Xiao, W. Replication competent helper functions for recombinant AAV vector generation. *Gene Ther* 9, 1199-1206 (2002).
17. Dean, D. A., Dean, B. S., Muller, S. & Smith, L. C. Sequence Requirements for Plasmid Nuclear Import. *Experimental Cell Research* 253, 713-722 (1999).
18. Gerling, T., Wagenbauer, K. F., Neuner, A. M. & Dietz, H. Dynamic DNA devices and assemblies formed by shape-complementary, non-base pairing 3D components. *Science* 347, 1446-1452 (2015).

The features of the present invention disclosed in the specification, the claims, and/or in the accompanying figures may, both separately and in any combination thereof, be material for realizing the invention in various forms thereof.

---

SEQUENCE LISTING (1507 sequences)

SEQ ID NO: 1 - DNA, 4027 bp, synthetic construct
  misc_feature 1..4027: note = nucleic acid sequence
  source 1..4027: mol_type = other DNA
cgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccactagtaacggccgccagtgtgctggaattctgcagatatccatcacactggcggccgctcgagatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaatgtgacattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcactcattgatata

SEQ ID NO: 2 - DNA, 4024 bp, synthetic construct
  misc_feature 1..4024: note = nucleic acid sequence
  source 1..4024: mol_type = other DNA
gtcgggtttcgccacctctgacttgagcgtcgatttttgtgatgctcgtcaggggggcggagcctatggaaaaacgccagcaacgcggcctttttacggttcctggccttttgctggccttttgctcactcattcgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagcatttaggtgacactatagaatagggccctctagattacttgtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatctcgagcggccgccagtgtgatggatatctgcagaattccagcacactggcggccgttactagtggatccgagctcggtaccaagcttgggtctccctatagtgagtcgtattaatttcgataagccagtaagcagtgggttctctagttagccagagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtatatctgtgacattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcct

SEQ ID NO: 3 - DNA, 4959 bp, synthetic construct
  misc_feature 1..4959: note = nucleic acid sequence
  source 1..4959: mol_type = other DNA
taggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccaggcggccgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataagcttggatccaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgagatctgcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggactcgagttaagggcgaattcccgataaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcacgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacccttaat

SEQ ID NO: 4 - DNA, 4784 bp, synthetic construct
  misc_feature 1..4784: note = nucleic acid sequence
  source 1..4784: mol_type = other DNA
gttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccaggcggccgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataagcttggatccaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgagatctgcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggactcgagttaagggcgaattcccgataaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcacgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacccttacattatgctctaggaagatcggaattcgcccttaagctagctagttattaatagtaatcaattacggggtcattagttcatagcccatatatgga

SEQ ID NO: 5 - DNA, 4816 bp, synthetic construct
  misc_feature 1..4816: note = nucleic acid sequence
  source 1..4816: mol_type = other DNA
taggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccaggcggccgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataagcttggatccaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgagatctgcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggactcgagttaagggcgaattcccgataaggatcttcctagagcatggctacgtagataagtagcatggcgcattgccttaattaacattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcacgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacccttaat

SEQ ID NO: 6 - DNA, 4823 bp, synthetic construct
  misc_feature 1..4823: note = nucleic acid sequence
  source 1..4823: mol_type = other DNA
attaggggcctcagtgagcgagcgagcgcgcagagagggagtggccaactccatcactaggggttccttgtagttaatgattaacccgccatgctacttatctacgtagccatgctctaggaagatcggaattcgcccttaagctagctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccaggcggccgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataagcttggatccaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgagatctgcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggactcgagttaagggcgaattcccgataaggatcttcctagagcatggctacgtagataagtagcatggcgggttaatcattaactacaaggaacccctagtgatggagttggccactccctctctgcgcgctcgctcgctcactgaggccccttaattaacattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcacgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcaccctta

SEQ ID NO: 7 - DNA, 4816 bp, synthetic construct
  misc_feature 1..4816: note = nucleic acid sequence
  source 1..4816: mol_type = other DNA
taggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccaggcattattcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtgagcgggtgattggatccaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgagatctgcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggactcgagttaagggcgaattcccgataaggatcttcctagagcatggctacgtagataagtagcatggcgcattgccttaattaacattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtcacgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacccttaat

SEQ ID NO: 8 - DNA, 4363 bp, synthetic construct
  misc_feature 1..4363: note = nucleic acid sequence
  source 1..4363: mol_type = other DNA
cgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttggtaccgagctcggatccactagtccagtgtggtggaattcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtgagcggccgctcgagtctagagggccgggtaagctcgctttcttgctgtccaatttctattaaaggttcctttgttccctaagtccaactactaaactggggattcctgggccctgaagaagggcccctcgactaagtccaactactaaactgggccctgaagaagggcccatatagggccctgaagaagggccctatcgaggatattatctcgactaagtccaactactaaactgggccctgaagaagggcccatatagggccctgaagaagggccctatcgaggatattatctcgaggatattatgaagggccttgagcatctggattctattctatagtgtcacctgctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctgtgacattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcactcatt

SEQ ID NO: 9 - DNA, 4086 bp, synthetic construct
  misc_feature 1..4086: note = nucleic acid sequence
  source 1..4086: mol_type = other DNA
gtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttggtaccgagctcggatccactagtccagtgtggtggaattcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtgagcggccgctcgagtctagagatccggtgtggaaagtccccaggctccccagcaggcagaagtatgcaaagcatgcatctcaattagtcagcaaccaaagctttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaacctgtgacattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcactcatt

SEQ ID NO: 10 - DNA, 4453 bp, synthetic construct
  misc_feature 1..4453: note = nucleic acid sequence
  source 1..4453: mol_type = other DNA
cgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttggtaccgagctcggatccactagtccagtgtggtggaattcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtgagcggccgctcgagtctagagggccgggtaaggagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctcgctttcttgctgtccaatttctattaaaggttcctttgttccctaagtccaactactaaactggggatgcggccgctcgagtctagagatccggtgtggaaagtccccaggctccccagcaggcagaagtatgcaaagcatgcatctcaattagtcagcaaccaaagctctagagatccggtgtggaaagtccccaggctccccagcaggcagaagtatgcaaagcatgcatctcaattagtcagcaaccaaagctttaaaccatccggtgtggaaagtccccaggctccccagcaggcagaagtatgcaaagcatgcatctcaattagtcagcaaccaaagctttaaacccgctgatcagcctcgactacaacaaggcaaggcttgaccgacaattgcatgaagaatctgcttagggttaggcgttttgcgctgctttgtgacattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcactcatt

SEQ ID NO: 11 - DNA, 4741 bp, synthetic construct
  misc_feature 1..4741: note = nucleic acid sequence
  source 1..4741: mol_type = other DNA
ggggatgcggccgctcgagtctagagatccggtgtggaaagtccccaggctccccagcaggcagaagtatgcaaagcatgcatctcaattagtcagcaaccaaagctctagagatccggtgtggaaagtccccaggctccccagcaggcagaagtatgcaaagcatgcatctcaattagtcagcaaccaaagctttaaaccatccggtgtggaaagtccccaggctccccagcaggcagaagtatgcaaagcatgcatctcaattagtcagcaaccaaagctttaaacccgctgatcagcctcgactatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttggtaccgagctcggatccactagtccagtgtggtggaattcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtgagcggccgctcgagtctagagggccgggtaaggagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggctcgctttcttgctgtccaatttctattaaaggttcctttgttccctaagtccaactactaaactggggatgcggccgctcgagtctagagatccggtgtggaaagtccccaggctccccagcaggcagaagtatgcaaagcatgcatctcaattagtcagcaaccaaagctctagagatccggtgtggaaagtccccaggctccccagcaggcagaagtatgcaaagcatgcatctcaattagtcagcaaccaaagctttaaaccatccggtgtggaaagtccccaggctccccagcaggcagaagtatgcaaagcatgcatctcaattagtcagcaaccaaagctttaaacccgctgatcagcctcgactacaacaaggcaaggcttgaccgacaattgcatgaagaatctgcttagggttaggcgttttgcgctgctttgtgacattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcactcatt

SEQ ID NO: 12 - DNA, 508 bp, synthetic construct
  misc_feature 1..508: note = nucleic acid sequence
  source 1..508: mol_type = other DNA
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagct

SEQ ID NO: 13 - DNA, 130 bp, synthetic construct
  misc_feature 1..130: note = nucleic acid sequence
  source 1..130: mol_type = other DNA
ctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 14 - DNA, 130 bp, synthetic construct
  misc_feature 1..130: note = nucleic acid sequence
  source 1..130: mol_type = other DNA
aggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 15 - DNA, 133 bp, synthetic construct
  misc_feature 1..133: note = nucleic acid sequence
  source 1..133: mol_type = other DNA
gtaagtatcaaggttacaagacaggtttaaggagaccaatagaaactgggcttgtcgagacagagaagactcttgcgtttctgataggcacctattggtcttactgacatccactttgcctttctctccacag

SEQ ID NO: 16 - DNA, 10 bp, synthetic construct
  misc_feature 1..10: note = nucleic acid sequence
  source 1..10: mol_type = other DNA
gccgccatgg

SEQ ID NO: 17 - DNA, 542 bp, synthetic construct
  misc_feature 1..542: note = nucleic acid sequence
  source 1..542: mol_type = other DNA
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcg

SEQ ID NO: 18 - DNA, 720 bp, synthetic construct
  misc_feature 1..720: note = nucleic acid sequence
  source 1..720: mol_type = other DNA
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 19 - DNA, 208 bp, synthetic construct
  misc_feature 1..208: note = nucleic acid sequence
  source 1..208: mol_type = other DNA
ctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctgggga

SEQ ID NO: 20 - DNA, 711 bp, synthetic construct
  misc_feature 1..711: note = nucleic acid sequence
  source 1..711: mol_type = other DNA
atggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtga

SEQ ID NO: 21 - DNA, 72 bp, synthetic construct
  misc_feature 1..72: note = nucleic acid sequence
  source 1..72: mol_type = other DNA
ggtgtggaaagtccccaggctccccagcaggcagaagtatgcaaagcatgcatctcaattagtcagcaacca

SEQ ID NO: 22 - DNA, 35 bp, synthetic construct
  misc_feature 1..35: note = nucleic acid sequence
  source 1..35: mol_type = other DNA
ctggatggtctccgtgacattaagcgcggcgggtg

SEQ ID NO: 23 - DNA, 36 bp, synthetic construct
  misc_feature 1..36: note = nucleic acid sequence
  source 1..36: mol_type = other DNA
ctggatggtctccaatgagtgagcaaaaggccagca

SEQ ID NO: 24 - DNA, 37 bp, synthetic construct
  misc_feature 1..37: note = nucleic acid sequence
  source 1..37: mol_type = other DNA
ctggatggtctcccattgatatacgcgttgacattga

SEQ ID NO: 25 - DNA, 36 bp, synthetic construct
  misc_feature 1..36: note = nucleic acid sequence
  source 1..36: mol_type = other DNA
ctggatggtctcctcacattccgcctcagaagccat

SEQ ID NO: 26 - DNA, 35 bp, synthetic construct
  misc_feature 1..35: note = nucleic acid sequence
  source 1..35: mol_type = other DNA
cactgacgtctctgtgacattaagcgcggcgggtg

SEQ ID NO: 27 - DNA, 36 bp, synthetic construct
  misc_feature 1..36: note = nucleic acid sequence
  source 1..36: mol_type = other DNA
cactgacgtctctaatgagtgagcaaaaggccagca

SEQ ID NO: 28 - DNA, 35 bp, synthetic construct
  misc_feature 1..35: note = nucleic acid sequence
  source 1..35: mol_type = other DNA
cactgacgtctctcattcgcctcagaagccataga

SEQ ID NO: 29 - DNA, 38 bp, synthetic construct
  misc_feature 1..38: note = nucleic acid sequence
  source 1..38: mol_type = other DNA
cactgacgtctcttcacagatatacgcgttgacattga

SEQ ID NO: 30 - DNA, 27 bp, synthetic construct
  misc_feature 1..27: note = nucleic acid sequence
  source 1..27: mol_type = other DNA
ttaattaacattaagcgcggcgggtgt

SEQ ID NO: 31 - DNA, 31 bp, synthetic construct
  misc_feature 1..31: note = nucleic acid sequence
  source 1..31: mol_type = other DNA
cctaattaagggtgagcaaaaggccagcaaa

SEQ ID NO: 32 - DNA, 37 bp, synthetic construct
  misc_feature 1..37: note = nucleic acid sequence
  source 1..37: mol_type = other DNA
cactgacgtctctcattatgctctaggaagatcggaa

SEQ ID NO: 33 - DNA, 37 bp, synthetic construct
  misc_feature 1..37: note = nucleic acid sequence
  source 1..37: mol_type = other DNA
cgtgatcgtctctaatgtaagggtgagcaaaaggcca

SEQ ID NO: 34 - DNA, 38 bp, synthetic construct
  misc_feature 1..38: note = nucleic acid sequence
  source 1..38: mol_type = other DNA
cactgacgtctctcattgccttaattaacattaagcgc

SEQ ID NO: 35 - DNA, 37 bp, synthetic construct
  misc_feature 1..37: note = nucleic acid sequence
  source 1..37: mol_type = other DNA
cactgacgtctctaatgcgccatgctacttatctacg

SEQ ID NO: 36 - DNA, 36 bp, synthetic construct
  misc_feature 1..36: note = nucleic acid sequence
  source 1..36: mol_type = other DNA
agatggcgtctccttaggggcctcagtgagcgagcg

SEQ ID NO: 37 - DNA, 34 bp, synthetic construct
  misc_feature 1..34: note = nucleic acid sequence
  source 1..34: mol_type = other DNA
agatggcgtctccaggggcctcagtgagcgagcg

SEQ ID NO: 38 - DNA, 35 bp, synthetic construct
  misc_feature 1..35: note = nucleic acid sequence
  source 1..35: mol_type = other DNA
agatggcgtctcccccttaattaacattaagcgcg

SEQ ID NO: 39 - DNA, 35 bp, synthetic construct
  misc_feature 1..35: note = nucleic acid sequence
  source 1..35: mol_type = other DNA
agatggcgtctccctaattaagggtgagcaaaagg

SEQ ID NO: 40 - DNA, 37 bp, synthetic construct
  misc_feature 1..37: note = nucleic acid sequence
  source 1..37: mol_type = other DNA
tggctacgtctcggtgattggatccaatcaacctctg

SEQ ID NO: 41 - DNA, 35 bp, synthetic construct
  misc_feature 1..35: note = nucleic acid sequence
  source 1..35: mol_type = other DNA
tggctacgtctcgaatgcctggacacctgtggaga

SEQ ID NO: 42 - DNA, 35 bp, synthetic construct
  misc_feature 1..35: note = nucleic acid sequence
  source 1..35: mol_type = other DNA
tggctacgtctcgcattattcgccaccatggtgag

SEQ ID NO: 43 - DNA, 35 bp, synthetic construct
  misc_feature 1..35: note = nucleic acid sequence
  source 1..35: mol_type = other DNA
tggctacgtctcgtcacccgctcacttgtacagct

SEQ ID NO: 44 - DNA, 35 bp, synthetic construct
  misc_feature 1..35: note = nucleic acid sequence
  source 1..35: mol_type = other DNA
caaggtggtctccgtgacattaagcgcggcgggtg

SEQ ID NO: 45 - DNA, 36 bp, synthetic construct
  misc_feature 1..36: note = nucleic acid sequence
  source 1..36: mol_type = other DNA
caaggtggtctccaatgagtgagcaaaaggccagca

SEQ ID NO: 46 - DNA, 35 bp, synthetic construct
  misc_feature 1..35: note = nucleic acid sequence
  source 1..35: mol_type = other DNA
caaggtggtctcgcattcgcgatgtacgggccaga

SEQ ID NO: 47 - DNA, 36 bp, synthetic construct
  misc_feature 1..36: note = nucleic acid sequence
  source 1..36: mol_type = other DNA
caaggtggtctcgtcacagagccccagctggttctt

SEQ ID NO: 48 - DNA, 35 bp, synthetic construct
  misc_feature 1..35: note = nucleic acid sequence
  source 1..35: mol_type = other DNA
tttccgggtctcggtgacattaagcgcggcgggtg

SEQ ID NO: 49 - DNA, 36 bp, synthetic construct
  misc_feature 1..36: note = nucleic acid sequence
  source 1..36: mol_type = other DNA
tttccgggtctcgaatgagtgagcaaaaggccagca

SEQ ID NO: 50 - DNA, 35 bp, synthetic construct
  misc_feature 1..35: note = nucleic acid sequence
  source 1..35: mol_type = other DNA
tttccgggtctcccattgtacgggccagatatacg

SEQ ID NO: 51 - DNA, 33 bp, synthetic construct
  misc_feature 1..33: note = nucleic acid sequence
  source 1..33: mol_type = other DNA
tttccgggtctccatctctagactcgagcggcc

SEQ ID NO: 52 - DNA, 34 bp, synthetic construct
  misc_feature 1..34: note = nucleic acid sequence
  source 1..34: mol_type = other DNA
tttccgggtctccgctttaaacccgctgatcagc

SEQ ID NO: 53 - DNA, 36 bp, synthetic construct
  misc_feature 1..36: note = nucleic acid sequence
  source 1..36: mol_type = other DNA
tttccgggtctcctcacaggttctttccgcctcaga

SEQ ID NO: 54 - DNA, 33 bp, synthetic construct
  misc_feature 1..33: note = nucleic acid sequence
  source 1..33: mol_type = other DNA
ttgtggggtctcggcctcgactgtgccttctag

SEQ ID NO: 55 - DNA, 36 bp, synthetic construct
  misc_feature 1..36: note = nucleic acid sequence
  source 1..36: mol_type = other DNA
ttgtggggtctcggagcggccgctcacttgtacagc

SEQ ID NO: 56 - DNA, 32 bp, synthetic construct
  misc_feature 1..32: note = nucleic acid sequence
  source 1..32: mol_type = other DNA
ttgtggggtctcggctcgagtctagagatccg

SEQ ID NO: 57 - DNA, 34 bp, synthetic construct
  misc_feature 1..34: note = nucleic acid sequence
  source 1..34: mol_type = other DNA
ttgtggggtctcgtttggttgctgactaattgag

SEQ ID NO: 58 - DNA, 37 bp, synthetic construct
  misc_feature 1..37: note = nucleic acid sequence
  source 1..37: mol_type = other DNA
ttgtggggtctcgcaaagctctagagatccggtgtgg

SEQ ID NO: 59 - DNA, 36 bp, synthetic construct
  misc_feature 1..36: note = nucleic acid sequence
  source 1..36: mol_type = other DNA
ttgtggggtctcggatggtttaaagctttggttgct

SEQ ID NO: 60 - DNA, 32 bp, synthetic construct
  misc_feature 1..32: note = nucleic acid sequence
  source 1..32: mol_type = other DNA
ttgtggggtctcgcatccggtgtggaaagtcc

SEQ ID NO: 61 - DNA, 33 bp, synthetic construct
  misc_feature 1..33: note = nucleic acid sequence
  source 1..33: mol_type = other DNA
ttgtggggtctcgaggctgatcagcgggtttaa

SEQ ID NO: 62 - DNA, 32 bp, synthetic construct
  misc_feature 1..32: note = nucleic acid sequence
  source 1..32: mol_type = other DNA
ttcgagggtctccttgtgacattaagcgcggc

SEQ ID NO: 63 - DNA, 31 bp, synthetic construct
  misc_feature 1..31: note = nucleic acid sequence
  source 1..31: mol_type = other DNA
ttcgagggtctcccttacccggccctctaga

SEQ ID NO: 64 - DNA, 35 bp, synthetic construct
  misc_feature 1..35: note = nucleic acid sequence
  source 1..35: mol_type = other DNA
ttcgagggtctcgtaaggagggcccgtttaaaccc

SEQ ID NO: 65 - DNA, 33 bp, synthetic construct
  misc_feature 1..33: note = nucleic acid sequence
  source 1..33: mol_type = other DNA
ttcgagggtctcgagccatagagcccaccgcat

SEQ ID NO: 66 - DNA, 33 bp, synthetic construct
  misc_feature 1..33: note = nucleic acid sequence
  source 1..33: mol_type = other DNA
ttcgagggtctcgggctcgctttcttgctgtcc

SEQ ID NO: 67 - DNA, 34 bp, synthetic construct
  misc_feature 1..34: note = nucleic acid sequence
  source 1..34: mol_type = other DNA
ttcgagggtctcgcatccccagtttagtagttgg

SEQ ID NO: 68 - DNA, 33 bp, synthetic construct
  misc_feature 1..33: note = nucleic acid sequence
  source 1..33: mol_type = other DNA
caagagggtctccatgcggccgctcgagtctag

SEQ ID NO: 69 - DNA, 32 bp, synthetic construct
  misc_feature 1..32: note = nucleic acid sequence
  source 1..32: mol_type = other DNA
caagagggtctcccgaggctgatcagcgggtt

SEQ ID NO: 70 - DNA, 33 bp, synthetic construct
  misc_feature 1..33: note = nucleic acid sequence
  source 1..33: mol_type = other DNA
aacaccggtctcggactacaacaaggcaaggct

SEQ ID NO: 71 - DNA, 34 bp, synthetic construct
  misc_feature 1..34: note = nucleic acid sequence
  source 1..34: mol_type = other DNA
aacaccggtctcgacaaagcagcgcaaaacgcct

SEQ ID NO: 72 - DNA, 38 bp, synthetic construct
  misc_feature 1..38: note = nucleic acid sequence
  source 1..38: mol_type = other DNA
gtacacggtctcggactatacgcgttgacattgattat

SEQ ID NO: 73 - DNA, 34 bp, synthetic construct
  misc_feature 1..34: note = nucleic acid sequence
  source 1..34: mol_type = other DNA
gtacacggtctcgccaatgagtgagcaaaaggcc

SEQ ID NO: 74 - DNA, 33 bp, synthetic construct
  misc_feature 1..33: note = nucleic acid sequence
  source 1..33: mol_type = other DNA
gtacacggtctcgttggggatgcggccgctcga

SEQ ID NO: 75 - DNA, 32 bp, synthetic construct
  misc_feature 1..32: note = nucleic acid sequence
  source 1..32: mol_type = other DNA
gtacacggtctcgagtcgaggctgatcagcgg

SEQ ID NO: 76 - DNA, 39 bp, synthetic construct
  misc_feature 1..39: note = nucleic acid sequence
  source 1..39: mol_type = other DNA
ggaagctccctcgtgcggcgggccgggcgacaaccaccg

SEQ ID NO: 77 - DNA, 38 bp, synthetic construct
  misc_feature 1..38: note = nucleic acid sequence
  source 1..38: mol_type = other DNA
ggactataaagatacggaactccggaaggctgcaagca

SEQ ID NO: 78 - DNA, 37 bp, synthetic construct
  misc_feature 1..37: note = nucleic acid sequence
  source 1..37: mol_type = other DNA
tccgcccccctgacgaataatcgtgcacccggggtct

SEQ ID NO: 79 - DNA, 38 bp, synthetic construct
  misc_feature 1..38: note = nucleic acid sequence
  source 1..38: mol_type = other DNA
gcgtttttaattcgcgttaaattttataaatagcagaa

SEQ ID NO: 80 - DNA, 30 bp, synthetic construct
  misc_feature 1..30: note = nucleic acid sequence
  source 1..30: mol_type = other DNA
atttaccaagtccctattggcgttgacgtc

SEQ ID NO: 81 - DNA, 30 bp, synthetic construct
  misc_feature 1..30: note = nucleic acid sequence
  source 1..30: mol_type = other DNA
attgattacacttgatgtactgcgatgtac

SEQ ID NO: 82 - DNA, 40 bp, synthetic construct
  misc_feature 1..40: note = nucleic acid sequence
  source 1..40: mol_type = other DNA
aaggccagtaatgccaggcgggcccaagtaggggtctccc

SEQ ID NO: 83 - DNA, 54 bp, synthetic construct
  misc_feature 1..54: note = nucleic acid sequence
  source 1..54: mol_type = other DNA
cgtcattattgacgtgtattgattttggtgccaaaacaaactcccattactatg

SEQ ID NO: 84 - DNA, 32 bp, synthetic construct
  misc_feature 1..32: note = nucleic acid sequence
  source 1..32: mol_type = other DNA
tcaatggagtaagttatgtaacgccaggcgtt

SEQ ID NO: 85 - DNA, 39 bp, synthetic construct
  misc_feature 1..39: note = nucleic acid sequence
  source 1..39: mol_type = other DNA
cgtaaatactccacccccgtgagaccgtacacgcctacc

SEQ ID NO: 86 - DNA, 32 bp, synthetic construct
  misc_feature 1..32: note = nucleic acid sequence
  source 1..32: mol_type = other DNA
cagtttacggctatgaactaatgagtggcgaa

SEQ ID NO: 87 - DNA, 32 bp, synthetic construct
  misc_feature 1..32: note = nucleic acid sequence
  source 1..32: mol_type = other DNA
atatgatactattaataactagtcagcatcac

SEQ ID NO: 88 - DNA, 54 bp, synthetic construct
  misc_feature 1..54: note = nucleic acid sequence
  source 1..54: mol_type = other DNA
gggggcgtatagcgaataagccagtaagcagagcggccgtaaacttccgcctcc

SEQ ID NO: 89 - DNA, 32 bp, synthetic construct
  misc_feature 1..32: note = nucleic acid sequence
  source 1..32: mol_type = other DNA
gctatccacgcccattcaagtgggaaaaaaag

SEQ ID NO: 90 - DNA, 38 bp, synthetic construct
  misc_feature 1..38: note = nucleic acid sequence
  source 1..38: mol_type = other DNA
ccatggtaacttggcttttctacaactgattcttgccc

SEQ ID NO: 91 - DNA, 40 bp, synthetic construct
  misc_feature 1..40: note = nucleic acid sequence
  source 1..40: mol_type = other DNA
tggggcggagttgttacacgctgaccgtcgtgtaccgcga

SEQ ID NO: 92 - DNA, 54 bp, synthetic construct
  misc_feature 1..54: note = nucleic acid sequence
  source 1..54: mol_type = other DNA
gcgtcaaaatggggtggagacttggaaatccattgacgtttttgttaaaatgcc

SEQ ID NO: 93 - DNA, 38 bp, synthetic construct
  misc_feature 1..38: note = nucleic acid sequence
  source 1..38: mol_type = other DNA
gccagagagctctgctgaacagcatcagtggccgagcg

SEQ ID NO: 94 - DNA, 39 bp, synthetic construct
  misc_feature 1..39: note = nucleic acid sequence
  source 1..39: mol_type = other DNA
agtcgtatgtggaacggtcattgacgcgtatatcaatga

SEQ ID NO: 95 - DNA, 37 bp, synthetic construct
  misc_feature 1..37: note = nucleic acid sequence
  source 1..37: mol_type = other DNA
tatagtgaattccagaagttttggaagcttcgtcgtt

SEQ ID NO: 96 - DNA, 52 bp, synthetic construct
  misc_feature 1..52: note = nucleic acid sequence
  source 1..52: mol_type = other DNA
cgccggacgacattttgatccggaacatattgggcggtcagccagctctcct

SEQ ID NO: 97 - DNA, 31 bp, synthetic construct
  misc_feature 1..31: note = nucleic acid sequence
  source 1..31: mol_type = other DNA
ccgtttacgtcgccggcccatttcggtggtt

SEQ ID NO: 98 - DNA, 32 bp, synthetic construct
  misc_feature 1..32: note = nucleic acid sequence
  source 1..32: mol_type = other DNA
ccttgctcaccatctcgtgggttcctttgatc

SEQ ID NO: 99 - DNA, 38 bp, synthetic construct
  misc_feature 1..38: note = nucleic acid sequence
  source 1..38: mol_type = other DNA
cgagggttgggcaccaccccggttatatagacgcgcag

SEQ ID NO: 100 - DNA, 39 bp, synthetic construct
  misc_feature 1..39: note = nucleic acid sequence
  source 1..39: mol_type = other DNA
agcggctgaactttatggtctgacgagttgccttcagca

SEQ ID NO: 101 - DNA, 46 bp, synthetic construct
  misc_feature 1..46: note = nucleic acid sequence
  source 1..46: mol_type = other DNA
tgtggcttcaccttgatgccgttggggcaaaagtgttataatcgga

SEQ ID NO: 102 - DNA, 39 bp, synthetic construct
  misc_feature 1..39: note = nucleic acid sequence
  source 1..39: mol_type = other DNA
tgtactccagcttgtagcttgccgctccagattcatcca

SEQ ID NO: 103 - DNA, 48 bp, synthetic construct
  misc_feature 1..48: note = nucleic acid sequence
  source 1..48: mol_type = other DNA
gccccaggccgtcctcgatgttgtggcacagtctccgatcagagcttg

SEQ ID NO: 104 - DNA, 39 bp, synthetic construct
  misc_feature 1..39: note = nucleic acid sequence
  source 1..39: mol_type = other DNA
atgttgccgtcctccttgaagtcggtggtcaccggaagg

SEQ ID NO: 105 - DNA, 30 bp, synthetic construct
  misc_feature 1..30: note = nucleic acid sequence
  source 1..30: mol_type = other DNA
gggtgtttcagctcgatgcggttcaccagg

SEQ ID NO: 106 - DNA, 38 bp, synthetic construct
  misc_feature 1..38: note = nucleic acid sequence
  source 1..38: mol_type = other DNA
cagcacggggccgtctagattaacgatcaagggcgcta

SEQ ID NO: 107 - DNA, 54 bp, synthetic construct
  misc_feature 1..54: note = nucleic acid sequence
  source 1..54: mol_type = other DNA
tcgggcagctcgaacttcacctcggcgcgggaagaagtctgttgccgaaatcaa

SEQ ID NO: 108 - DNA, 37 bp, synthetic construct
  misc_feature 1..37: note = nucleic acid sequence
  source 1..37: mol_type = other DNA
actgggtgctcaggtagtgatctggtatgacgctgcg

SEQ ID NO: 109 - DNA, 36 bp, synthetic construct
  misc_feature 1..36: note = nucleic acid sequence
  source 1..36: mol_type = other DNA
ggctggcaactagaaggcggatctcaccgggtggtg

SEQ ID NO: 110 - DNA, 48 bp, synthetic construct
  misc_feature 1..48: note = nucleic acid sequence
  source 1..48: mol_type = other DNA
atgccgagagtggttgctattaatgtgctgcttgatggatatctgcag

SEQ ID NO: 111 - DNA, 47 bp, synthetic construct
  misc_feature 1..47: note = nucleic acid sequence
  source 1..47: mol_type = other DNA
ccggcggcgcctgctattgtcttcccaatcctagcggtcgcttcatt

SEQ ID NO: 112 - DNA, 30 bp, synthetic construct
  misc_feature 1..30: note = nucleic acid sequence
  source 1..30: mol_type = other DNA
ggtcaagaagcactacactcatggttacta

SEQ ID NO: 113 - DNA, 54 bp, synthetic construct
  misc_feature 1..54: note = nucleic acid sequence
  source 1..54: mol_type = other DNA
attttattaggaaaggccgatttgttgtcagccgtaagatagttgccctggtag

SEQ ID NO: 114 - DNA, 38 bp, synthetic construct
  misc_feature 1..38: note = nucleic acid sequence
  source 1..38: mol_type = other DNA
cgatgcagatcagcgagctctaggcgagctgcagccag

SEQ ID NO: 115 - DNA, 48 bp, synthetic construct
  misc_feature 1..48: note = nucleic acid sequence
  source 1..48: mol_type = other DNA
ccagaataatagaatagggccctcgccgatggggtcctgcaagcactg

SEQ ID NO: 116 - DNA, 39 bp, synthetic construct
  misc_feature 1..39: note = nucleic acid sequence
  source 1..39: mol_type = other DNA
accacacccccagcatggtcacgaactccagtctttgct

SEQ ID NO: 117 - DNA, 39 bp, synthetic construct
  misc_feature 1..39: note = nucleic acid sequence
  source 1..39: mol_type = other DNA
tcaccctaatcaagttttattgaactcatacgggggtcg

SEQ ID NO: 118 - DNA, 31 bp, synthetic construct
  misc_feature 1..31: note = nucleic acid sequence
  source 1..31: mol_type = other DNA
ctatcagggcgatggcatgagcggggaataa

SEQ ID NO: 119 - DNA, 30 bp, synthetic construct
  misc_feature 1..30: note = nucleic acid sequence
  source 1..30: mol_type = other DNA
aacgtcaaaaaataacaaaaacaatatatg

SEQ ID NO: 120 - DNA, 31 bp, synthetic construct
  misc_feature 1..31: note = nucleic acid sequence
  source 1..31: mol_type = other DNA
tttggaacaagagtcttccccgatcttttac

SEQ ID NO: 121 - DNA, 31 bp, synthetic construct
  misc_feature 1..31: note = nucleic acid sequence
  source 1..31: mol_type = other DNA
aatcggcaaaatccctttgttaatcttaccg

SEQ ID NO: 122 - DNA, 54 bp, synthetic construct
  misc_feature 1..54: note = nucleic acid sequence
  source 1..54: mol_type = other DNA
tttgaatgtatttagaagggcgaaggtgagtattagctccaataaaccacgctg

SEQ ID NO: 123 - DNA, 46 bp, synthetic construct
  misc_feature 1..46: note = nucleic acid sequence
  source 1..46: mol_type = other DNA
gggttccgcgcacatcactattaagtgtatgacatgatccagaagt

SEQ ID NO: 124 - DNA, 53 bp, synthetic construct
  misc_feature 1..53: note = nucleic acid sequence
  source 1..53: mol_type = other DNA
aaagtgccaaaaatcgacgctcaagtcagagccccgtatttcaccagatctca

SEQ ID NO: 125 - DNA, 45 bp, synthetic construct
  misc_feature 1..45: note = nucleic acid sequence
  source 1..45: mol_type = other DNA
acctaaattgtaagcttgagtgtggcgtcacagctccgatccagt

SEQ ID NO: 126 - DNA, 37 bp, synthetic construct
  misc_feature 1..37: note = nucleic acid sequence
  source 1..37: mol_type = other DNA
gcgtttcctgagaataagaacggaagggaagaaagcg

SEQ ID NO: 127 - DNA, 31 bp, synthetic construct
  misc_feature 1..31: note = nucleic acid sequence
  source 1..31: mol_type = other DNA
ctgtgactaaaccgtacggggaaagccggcg

SEQ ID NO: 128 - DNA, 62 bp, synthetic construct
  misc_feature 1..62: note = nucleic acid sequence
  source 1..62: mol_type = other DNA
atacgggatctaaagtgacgctcataatttcgtgactaatacgtagatgtactgcatttacc

SEQ ID NO: 129 - DNA, 44 bp, synthetic construct
  misc_feature 1..44: note = nucleic acid sequence
  source 1..44: mol_type = other DNA
ccccatgtgacactgaatgacacctactcagacaatgaacgtgg

SEQ ID NO: 130 - DNA, 46 bp, synthetic construct
  misc_feature 1..46: note = nucleic acid sequence
  source 1..46: mol_type = other DNA
gttcccacttgtacagctgtcctgccccaccccaccccaaaggagc

SEQ ID NO: 131 - DNA, 31 bp, synthetic construct
  misc_feature 1..31: note = nucleic acid sequence
  source 1..31: mol_type = other DNA
catcgtggctttaaaattttaaaggattttg

SEQ ID NO: 132 - DNA, 53 bp, synthetic construct
  misc_feature 1..53: note = nucleic acid sequence
  source 1..53: mol_type = other DNA
tagataactaattctgttgaatagcatttagttccgaccctgccgcttaccct

SEQ ID NO: 133 - DNA, 31 bp, synthetic construct
  misc_feature 1..31: note = nucleic acid sequence
  source 1..31: mol_type = other DNA
tgactccacttgtggcagatgaacttcaggg

SEQ ID NO: 134 - DNA, 32 bp, synthetic construct
  misc_feature 1..32: note = nucleic acid sequence
  source 1..32: mol_type = other DNA
gatctgtcgaccaggagggccagggcacgggc

SEQ ID NO: 135 - DNA, 38 bp, synthetic construct
  misc_feature 1..38: note = nucleic acid sequence
  source 1..38: mol_type = other DNA
atatatgagccagtgtcatgtggtcggggtgtgtcgcc

SEQ ID NO: 136 - DNA, 39 bp, synthetic construct
  misc_feature 1..39: note = nucleic acid sequence
  source 1..39: mol_type = other DNA
ttaaaaatgcacactgggcatggcggacttgtcttgtag

SEQ ID NO: 137 - DNA, 55 bp, synthetic construct
  misc_feature 1..55: note = nucleic acid sequence
  source 1..55: mol_type = other DNA
ggcaaacaacggaaatcttactgtgtgaaccaaccctaaagggagcccacagtgg

SEQ ID NO: 138 - DNA, 47 bp, synthetic construct
  misc_feature 1..47: note = nucleic acid sequence
  source 1..47: mol_type = other DNA
caatgggctcttccttaaagagttgggagggcactcgccctcgccct

SEQ ID NO: 139 - DNA, 46 bp, synthetic construct
  misc_feature 1..46: note = nucleic acid sequence
  source 1..46: mol_type = other DNA
tccagctctatttcgtttatcagcttcggtccgaggctatttcctc

SEQ ID NO: 140 - DNA, 40 bp, synthetic construct
  misc_feature 1..40: note = nucleic acid sequence
  source 1..40: mol_type = other DNA
agtggtcgcatttaggttgtgcaacgagaaagtggactcc

SEQ ID NO: 141 - DNA, 39 bp, synthetic construct
  misc_feature 1..39: note = nucleic acid sequence
  source 1..39: mol_type = other DNA
tgttccaggggcgctggcaagtgtcccccttgctcgtcc

SEQ ID NO: 142 - DNA, 47 bp, synthetic construct
  misc_feature 1..47: note = nucleic acid sequence
  source 1..47: mol_type = other DNA
tagaccgagataggggttaatatacccactcaatgtcaacgtcaata

SEQ ID NO: 143 - DNA, 62 bp, synthetic construct
  misc_feature 1..62: note = nucleic acid sequence
  source 1..62: mol_type = other DNA
tcagggttattgtctcccactaccatgccataagtaaggacccacgcttgaagtgttgtagt

SEQ ID NO: 144 - DNA, 30 bp, synthetic construct
  misc_feature 1..30: note = nucleic acid sequence
  source 1..30: mol_type = other DNA
tgcttttgcaaaaaagatacatatccccct

SEQ ID NO: 145 - DNA, 31 bp, synthetic construct
  misc_feature 1..31: note = nucleic acid sequence
  source 1..31: mol_type = other DNA
taataccgcgatgtatttgttaaccataggc

SEQ ID NO: 146 - DNA, 32 bp, synthetic construct
  misc_feature 1..32: note = nucleic acid sequence
  source 1..32: mol_type = other DNA
ttggccgccaacagatgagtggcaccttccag

SEQ ID NO: 147 - DNA, 44 bp, synthetic construct
  misc_feature 1..44: note = nucleic acid sequence
  source 1..44: mol_type = other DNA
aaaagcggctcaaccatctcagcgcagattacctccctcaaacc

SEQ ID NO: 148 - DNA, 55 bp, synthetic construct
  misc_feature 1..55: note = nucleic acid sequence
  source 1..55: mol_type = other DNA
ggcgagttcggcgaccagttaccagaagatctctagttatgccaaaaccgcatca

SEQ ID NO: 149 - DNA, 40 bp, synthetic construct
  misc_feature 1..40: note = nucleic acid sequence
  source 1..40: mol_type = other DNA
aggcacctaagtcatttgggtgagacaaatagacccgaca

SEQ ID NO: 150 - DNA, 46 bp, synthetic construct
  misc_feature 1..46: note = nucleic acid sequence
  source 1..46: mol_type = other DNA
aatgcttatcctcgccacgccgtaggtcaggatgccctctgctggt

SEQ ID NO: 151 - DNA, 38 bp, synthetic construct
  misc_feature 1..38: note = nucleic acid sequence
  source 1..38: mol_type = other DNA
aaaactcatccagttcgccacatcaaaagaacgtaacc

SEQ ID NO: 152 - DNA, 55 bp, synthetic construct
  misc_feature 1..55: note = nucleic acid sequence
  source 1..55: mol_type = other DNA
tttttggaaccgtaaaaaggccgcgttgctggtgagcaactgttgagacgttaag

SEQ ID NO: 153 - DNA, 50 bp, synthetic construct
  misc_feature 1..50: note = nucleic acid sequence
  source 1..50: mol_type = other DNA
tttttgcgtggcgctttctcattctcccggcggtgtttcaatattttggg

SEQ ID NO: 154 - DNA, 27 bp, synthetic construct
  misc_feature 1..27: note = nucleic acid sequence
  source 1..27: mol_type = other DNA
tttttgtatctcagttcggttagctca

SEQ ID NO: 155 - DNA, 61 bp, synthetic construct
  misc_feature 1..61: note = nucleic acid sequence
  source 1..61: mol_type = other DNA
caagcttgaaagtcccataaggtcatttttttttttgtactgggcacaaaaggccattttt

SEQ ID NO: 156 - DNA, 40 bp, synthetic construct
  misc_feature 1..40: note = nucleic acid sequence
  source 1..40: mol_type = other DNA
tttttcgagctcggtacgtcatgagattatcaaaattttt

SEQ ID NO: 157 - DNA, 44 bp, synthetic construct
  misc_feature 1..44: note = nucleic acid sequence
  source 1..44: mol_type = other DNA
ttttttttttgggctgtgtgcttatctgcgctctgctgattttt

SEQ ID NO: 158 - DNA, 33 bp, synthetic construct
  misc_feature 1..33: note = nucleic acid sequence
  source 1..33: mol_type = other DNA
tttttgctcctggacgtcagttaatctagatcc

SEQ ID NO: 159 - DNA, 58 bp, synthetic construct
  misc_feature 1..58: note = nucleic acid sequence
  source 1..58: mol_type = other DNA
ttttttttttgaccgctgcgccttatcggccatgatatagacgttcagcttgcaatga

SEQ ID NO: 160 - DNA, 43 bp, synthetic construct
  misc_feature 1..43: note = nucleic acid sequence
  source 1..43: mol_type = other DNA
tttttcgcttctcgttggggcaggaccactacaggttaatgtc

SEQ ID NO: 161 - DNA, 39 bp, synthetic construct
  misc_feature 1..39: note = nucleic acid sequence
  source 1..39: mol_type = other DNA
tttttcttgagtccaacccggggcacgggggacttctgc

SEQ ID NO: 162 - DNA, 39 bp, synthetic construct
  misc_feature 1..39: note = nucleic acid sequence
  source 1..39: mol_type = other DNA
ttttttcagaagccatagagcccaccgcatccgccgcgc

SEQ ID NO: 163 - DNA, 63 bp, synthetic construct
  misc_feature 1..63: note = nucleic acid sequence
  source 1..63: mol_type = other DNA
tttttgcagcagccactggtagaggtgccgtagaataagacacgacttatcgccactgttttt

SEQ ID NO: 164 - DNA, 31 bp, synthetic construct
  misc_feature 1..31: note = nucleic acid sequence
  source 1..31: mol_type = other DNA
tttttcaataggccgaacattccgccttttt

SEQ ID NO: 165 - DNA, 41 bp, synthetic construct
  misc_feature 1..41: note = nucleic acid sequence
  source 1..41: mol_type = other DNA
tttttttcggggcgaaaactccattggaaaacgttcttttt

SEQ ID NO: 166 - DNA, 69 bp, synthetic construct
  misc_feature 1..69: note = nucleic acid sequence
  source 1..69: mol_type = other DNA
tttttgaagtggtggccgtcacaggattagcagagttttttttttcgaggtatgtattcgggaattttt

SEQ ID NO: 167 - DNA, 66 bp, synthetic construct
  misc_feature 1..66: note = nucleic acid sequence
  source 1..66: mol_type = other DNA
taatggcagcactgcatacgatacggtagctcttggaaagtcccgggtcgttcgctccaagttttt

SEQ ID NO: 168 - DNA, 38 bp, synthetic construct
  misc_feature 1..38: note = nucleic acid sequence
  source 1..38: mol_type = other DNA
gtgctcattcaaggaatcagctcattttttaacttttt

SEQ ID NO: 169 - DNA, 57 bp, synthetic construct
  misc_feature 1..57: note = nucleic acid sequence
  source 1..57: mol_type = other DNA
tgtcacgcagagtaagcagggcggttgccgtcgtccttgaagaagatggtgcttttt

SEQ ID NO: 170 - DNA, 31 bp, synthetic construct
  misc_feature 1..31: note = nucleic acid sequence
  source 1..31: mol_type = other DNA
tttttgttgttgccattgtgtgatcgttttt

SEQ ID NO: 171 - DNA, 41 bp, synthetic construct
  misc_feature 1..41: note = nucleic acid sequence
  source 1..41: mol_type = other DNA
tttttacagtatttggtacccggctacactagaagattttt

SEQ ID NO: 172 - DNA, 31 bp, synthetic construct
  misc_feature 1..31: note = nucleic acid sequence
  source 1..31: mol_type = other DNA
atctggccttgtccggtaactatcgtttttt

SEQ ID NO: 173 - DNA, 42 bp, synthetic construct
  misc_feature 1..42: note = nucleic acid sequence
  source 1..42: mol_type = other DNA
ccagtgctgccgtaggtggcagaaccccccgttcagcttttt

SEQ ID NO: 174 - DNA, 41 bp, synthetic construct
  misc_feature 1..41: note = nucleic acid sequence
  source 1..41: mol_type = other DNA
tagttcgcagccttcggcggccgttactagtggatcttttt

SEQ ID NO: 175 - DNA, 33 bp, synthetic construct
  misc_feature 1..33: note = nucleic acid sequence
  source 1..33: mol_type = other DNA
tttttaggatcttcacagtttgcgcaacttttt

SEQ ID NO: 176 - DNA, 28 bp, synthetic construct
  misc_feature 1..28: note = nucleic acid sequence
  source 1..28: mol_type = other DNA
tttttagccagttaccgctgtagttttt

SEQ ID NO: 177 - DNA, 26 bp, synthetic construct
  misc_feature 1..26: note = nucleic acid sequence
  source 1..26: mol_type = other DNA
cttcggaactacagagttcttttttt

SEQ ID NO: 178 - DNA, 47 bp, synthetic construct
  misc_feature 1..47: note = nucleic acid sequence
  source 1..47: mol_type = other DNA
tggaagctccctcgtgcttggcgggccttgggcgacttaaccaccgt

SEQ ID NO: 179 - DNA, 46 bp, synthetic construct
  misc_feature 1..46: note = nucleic acid sequence
  source 1..46: mol_type = other DNA
tggactataaagatacttggaactccttggaaggctttgcaagcat

SEQ ID NO: 180 - DNA, 45 bp, synthetic construct
  misc_feature 1..45: note = nucleic acid sequence
  source 1..45: mol_type = other DNA
ttccgcccccctgacgttaataatcttgtgcacccttggggtctt

SEQ ID NO: 181 - DNA, 46 bp, synthetic construct
  misc_feature 1..46: note = nucleic acid sequence
  source 1..46: mol_type = other DNA
tgcgtttttttaattcgcgttaaattttttataaatttagcagaat

SEQ ID NO: 182 - DNA, 36 bp, synthetic construct
  misc_feature 1..36: note = nucleic acid sequence
  source 1..36: mol_type = other DNA
tatttaccttaagtccctattggcgttttgacgtct

SEQ ID NO: 183 - DNA, 36 bp, synthetic construct
  misc_feature 1..36: note = nucleic acid sequence
  source 1..36: mol_type = other DNA
tattgattattcacttgatgtactgcttgatgtact

SEQ ID NO: 184 - DNA, 48 bp, synthetic construct
  misc_feature 1..48: note = nucleic acid sequence
  source 1..48: mol_type = other DNA
taaggccagtttaatgccaggcgggccttcaagtaggttggtctccct

SEQ ID NO: 185 - DNA, 62 bp, synthetic construct
  misc_feature 1..62: note = nucleic acid sequence
  source 1..62: mol_type = other DNA
tcgtcattattgacgtttgtattttgattttggtgccaaaacaaactcccattttactatgt

SEQ ID NO: 186 - DNA, 38 bp, synthetic construct
  misc_feature 1..38: note = nucleic acid sequence
  source 1..38: mol_type = other DNA
ttcaatggattgtaagttatgtaacgcttcaggcgttt

SEQ ID NO: 187 - DNA, 45 bp, synthetic construct
  misc_feature 1..45: note = nucleic acid sequence
  source 1..45: mol_type = other DNA
tcgtaaatactccaccttcccgtgagttaccgtacacgcctacct

SEQ ID NO: 188 - DNA, 38 bp, synthetic construct
  misc_feature 1..38: note = nucleic acid sequence
  source 1..38: mol_type = other DNA
tcagtttacttggctatgaactaatgattgtggcgaat

SEQ ID NO: 189 - DNA, 38 bp, synthetic construct
  misc_feature 1..38: note = nucleic acid sequence
  source 1..38: mol_type = other DNA
tatatgatattctattaataactagtcttagcatcact

SEQ ID NO: 190 - DNA, 66 bp, synthetic construct
  misc_feature 1..66: note = nucleic acid sequence
  source 1..66: mol_type = other DNA
tgggggcgtttatagcgattataagccagtaagcattgagcggccttgtaaacttttccgcctcct

SEQ ID NO: 191 - DNA, 38 bp, synthetic construct
  misc_feature 1..38: note = nucleic acid sequence
  source 1..38: mol_type = other DNA
tgctatccacgcccattttcaagtgggttaaaaaaagt

SEQ ID NO: 192 - DNA, 48 bp, synthetic construct
  misc_feature 1..48: note = nucleic acid sequence
  source 1..48: mol_type = other DNA
tccatggtattacttggcttttttctacttaactgattttcttgccct

SEQ ID NO: 193 - DNA, 48 bp, synthetic construct
  misc_feature 1..48: note = nucleic acid sequence
  source 1..48: mol_type = other DNA
ttggggcggagttgttattcacgctgattccgtcgtgtttaccgcgat

SEQ ID NO: 194 - DNA, 64 bp, synthetic construct
  misc_feature 1..64: note = nucleic acid sequence
  source 1..64: mol_type = other DNA
tgcgtcaattaatggggtggagacttggaaatcttcattgacgtttttttgttttaaaatgcct

SEQ ID NO: 195 - DNA, 46 bp, synthetic construct
  misc_feature 1..46: note = nucleic acid sequence
  source 1..46: mol_type = other DNA
tgccagagagctctgctttgaacagcttatcagtgttgccgagcgt

SEQ ID NO: 196 - DNA, 49 bp, synthetic construct
  misc_feature 1..49: note = nucleic acid sequence
  source 1..49: mol_type = other DNA
tagtcgtatttgtggaacgttgtcattgattcgcgtttatatcaatgat

SEQ ID NO: 197 - DNA, 47 bp, synthetic construct
  misc_feature 1..47: note = nucleic acid sequence
  source 1..47: mol_type = other DNA
ttatagtgttaattccattgaagttttttggaagcttttcgtcgttt

SEQ ID NO: 198 - DNA, 64 bp, synthetic construct
  misc_feature 1..64: note = nucleic acid sequence
  source 1..64: mol_type = other DNA
tcgccggattcgacattttttgatccttggaacatattttgggcggtcagccattgctctcctt

SEQ ID NO: 199 - DNA, 37 bp, synthetic construct
  misc_feature 1..37: note = nucleic acid sequence
  source 1..37: mol_type = other DNA
tccgtttacgtcgccgttgcccatttttcggtggttt

SEQ ID NO: 200 - DNA, 38 bp, synthetic construct
  misc_feature 1..38: note = nucleic acid sequence
  source 1..38: mol_type = other DNA
tccttgctcaccatctcttgtgggttcttctttgatct

SEQ ID NO: 201 - DNA, 46 bp, synthetic construct
  misc_feature 1..46: note = nucleic acid sequence
  source 1..46: mol_type = other DNA
tcgagggttttgggcaccaccccggttttatatagttacgcgcagt

SEQ ID NO: 202 - DNA, 49 bp, synthetic construct
  misc_feature 1..49: note = nucleic acid sequence
  source 1..49: mol_type = other DNA
tagcggctgttaactttatttggtctgattcgagttgcttcttcagcat

SEQ ID NO: 203 - DNA, 56 bp, synthetic construct
  misc_feature 1..56: note = nucleic acid sequence
  source 1..56: mol_type = other DNA
ttgtggcttttcaccttgatgccgttttggggcaaattagtgttatttaatcggat

SEQ ID NO: 204 - DNA, 47 bp, synthetic construct
  misc_feature 1..47: note = nucleic acid sequence
  source 1..47: mol_type = other DNA
ttgtactccagcttgtttagcttgccttgctccagattttcatccat

SEQ ID NO: 205 - DNA, 58 bp, synthetic construct
  misc_feature 1..58: note = nucleic acid sequence
  source 1..58: mol_type = other DNA
tgccccaggttccgtcctcgatgttgtttggcacagtttctccgatcttagagcttgt

SEQ ID NO: 206 - DNA, 45 bp, synthetic construct
  misc_feature 1..45: note = nucleic acid sequence
  source 1..45: mol_type = other DNA
tatgttgccgtcctccttgaagtcttggtggtcattccggaaggt

SEQ ID NO: 207 - DNA, 34 bp, synthetic construct
  misc_feature 1..34: note = nucleic acid sequence
  source 1..34: mol_type = other DNA
tgggtgtttttcagctcgatgcggttcaccaggt

SEQ ID NO: 208 - DNA, 46 bp, synthetic construct
  misc_feature 1..46: note = nucleic acid sequence
  source 1..46: mol_type = other DNA
tcagcacggggccgtctttagattattacgatcaattgggcgctat

SEQ ID NO: 209 - DNA, 64 bp, synthetic construct
  misc_feature 1..64: note = nucleic acid sequence
  source 1..64: mol_type = other DNA
ttcgggcagttctcgaacttcacctcggcgcgggttaagaagtctttgttgccgttaaatcaat

SEQ ID NO: 210 - DNA, 45 bp, synthetic construct
  misc_feature 1..45: note = nucleic acid sequence
  source 1..45: mol_type = other DNA
tactgggtgctcaggtttagtgatctttggtatgttacgctgcgt

SEQ ID NO: 211 - DNA, 44 bp, synthetic construct
  misc_feature 1..44: note = nucleic acid sequence
  source 1..44: mol_type = other DNA
tggctggcaactagaattggcggatttctcaccgttggtggtgt

SEQ ID NO: 212 - DNA, 58 bp, synthetic construct
  misc_feature 1..58: note = nucleic acid sequence
  source 1..58: mol_type = other DNA
tatgccgagttagtggttgttctattaatttgtgctgcttttgatggatatctgcagt

SEQ ID NO: 213 - DNA, 55 bp, synthetic construct
  misc_feature 1..55: note = nucleic acid sequence
  source 1..55: mol_type = other DNA
tccggcggcttgcctgctattgtcttcccaatcctttagcggtcttgcttcattt

SEQ ID NO: 214 - DNA, 38 bp, synthetic construct
  misc_feature 1..38: note = nucleic acid sequence
  source 1..38: mol_type = other DNA
tggtcaagttaagcactattcactcatggttattctat

SEQ ID NO: 215 - DNA, 66 bp, synthetic construct
  misc_feature 1..66: note = nucleic acid sequence
  source 1..66: mol_type = other DNA
tattttattaggaaaggttccgatttttgttgtcagttccgtaagatttagttgccttctggtagt

SEQ ID NO: 216 - DNA, 46 bp, synthetic construct
  misc_feature 1..46: note = nucleic acid sequence
  source 1..46: mol_type = other DNA
tcgatgcattgatcagcgagctctagttgcgagctgttcagccagt

SEQ ID NO: 217 - DNA, 58 bp, synthetic construct
  misc_feature 1..58: note = nucleic acid sequence
  source 1..58: mol_type = other DNA
tccagaatattatagaatagggccctcttgccgatggttggtcctgcttaagcactgt

SEQ ID NO: 218 - DNA, 47 bp, synthetic construct
  misc_feature 1..47: note = nucleic acid sequence
  source 1..47: mol_type = other DNA
taccacaccttcccagcatttggtcacgaactccagtttctttgctt

SEQ ID NO: 219 - DNA, 47 bp, synthetic construct
  misc_feature 1..47: note = nucleic acid sequence
  source 1..47: mol_type = other DNA
ttcaccctaatcaagttttttattgaattctcatacttgggggtcgt

SEQ ID NO: 220 - DNA, 37 bp, synthetic construct
  misc_feature 1..37: note = nucleic acid sequence
  source 1..37: mol_type = other DNA
tctatcagggcgatggcttatgagcgttgggaataat

SEQ ID NO: 221 - DNA, 38 bp, synthetic construct
  misc_feature 1..38: note = nucleic acid sequence
  source 1..38: mol_type = other DNA
taacgtcaattaaaataattcaaaaacattatatatgt

SEQ ID NO: 222 - DNA, 37 bp, synthetic construct
  misc_feature 1..37: note = nucleic acid sequence
  source 1..37: mol_type = other DNA
ttttggaacaagagtcttttccccgatttcttttact

SEQ ID NO: 223 - DNA, 37 bp, synthetic construct
  misc_feature 1..37: note = nucleic acid sequence
  source 1..37: mol_type = other DNA
taatcggcaaaatccctttttgttaatttcttaccgt

SEQ ID NO: 224 - DNA, 66 bp, synthetic construct
  misc_feature 1..66: note = nucleic acid sequence
  source 1..66: mol_type = other DNA
ttttgaatgtatttagattagggcgaattggtgagtattttagctcttcaataaacttcacgctgt

SEQ ID NO: 225 - DNA, 56 bp, synthetic construct
  misc_feature 1..56: note = nucleic acid sequence
  source 1..56: mol_type = other DNA
tgggttccgcgcacatttcactattattagtgtatgttacatgatcttcagaagtt

SEQ ID NO: 226 - DNA, 63 bp, synthetic construct
  misc_feature 1..63: note = nucleic acid sequence
  source 1..63: mol_type = other DNA
taaagtgccttaaaaatcgacgctcaagtcagagttccccgtatttttcaccattgatctcat

SEQ ID NO: 227 - DNA, 55 bp, synthetic construct
  misc_feature 1..55: note = nucleic acid sequence
  source 1..55: mol_type = other DNA
tacctaaattgtaagcttttgagtgtttggcgtcattcagctccgttatccagtt

SEQ ID NO: 228 - DNA, 45 bp, synthetic construct
  misc_feature 1..45: note = nucleic acid sequence
  source 1..45: mol_type = other DNA
tgcgtttcttctgagaatttaagaacgttgaagggaagaaagcgt

SEQ ID NO: 229 - DNA, 37 bp, synthetic construct
  misc_feature 1..37: note = nucleic acid sequence
  source 1..37: mol_type = other DNA
tctgtgactttaaaccgtttacggggaaagccggcgt

SEQ ID NO: 230 - DNA, 74 bp, synthetic construct
  misc_feature 1..74: note = nucleic acid sequence
  source 1..74: mol_type = other DNA
tatacgggatttctaaagtttgacgctcatttaatttcgtttgactaatacgtagatgtactgcttatttacct

SEQ ID NO: 231 - DNA, 52 bp, synthetic construct
  misc_feature 1..52: note = nucleic acid sequence
  source 1..52: mol_type = other DNA
tccccatgtttgacactttgaatgacacctactcagacaatgttaacgtggt

SEQ ID NO: 232 - DNA, 54 bp, synthetic construct
  misc_feature 1..54: note = nucleic acid sequence
  source 1..54: mol_type = other DNA
tgttcccattcttgtacattgctgtcctgccccaccccaccccttaaaggagct

SEQ ID NO: 233 - DNA, 39 bp, synthetic construct
  misc_feature 1..39: note = nucleic acid sequence
  source 1..39: mol_type = other DNA
tcatcgtggttctttaaaattttttaaattggattttgt

SEQ ID NO: 234 - DNA, 65 bp, synthetic construct
  misc_feature 1..65: note = nucleic acid sequence
  source 1..65: mol_type = other DNA
ttagataactttaattctttgttgaatattgcatttattgttccgaccctgccgcttaccttctt

SEQ ID NO: 235 - DNA, 37 bp, synthetic construct
  misc_feature 1..37: note = nucleic acid sequence
  source 1..37: mol_type = other DNA
ttgactccttacttgtggttcagatgaacttcagggt

SEQ ID NO: 236 - DNA, 38 bp, synthetic construct
  misc_feature 1..38: note = nucleic acid sequence
  source 1..38: mol_type = other DNA
tgatctgtcttgaccaggattgggccagggcacgggct

SEQ ID NO: 237 - DNA, 46 bp, synthetic construct
  misc_feature 1..46: note = nucleic acid sequence
  source 1..46: mol_type = other DNA
tatatatgattgccagtgtttcatgtggtcggggtttgtgtcgcct

SEQ ID NO: 238 - DNA, 47 bp, synthetic construct
  misc_feature 1..47: note = nucleic acid sequence
  source 1..47: mol_type = other DNA
tttaaaaatttgcacactgttggcatggcggacttgtttcttgtagt

SEQ ID NO: 239 - DNA, 67 bp, synthetic construct
  misc_feature 1..67: note = nucleic acid sequence
  source 1..67: mol_type = other DNA
tggcaaacattacggaaatttcttactgtttgtgaaccattaccctaaagggagcccttacagtggt

SEQ ID NO: 240 - DNA, 59 bp, synthetic construct
  misc_feature 1..59: note = nucleic acid sequence
  source 1..59: mol_type = other DNA
tcaatgggctttcttccttttaaagagttttgggagggttcactttcgccctcgccctt

SEQ ID NO: 241 - DNA, 58 bp, synthetic construct
  misc_feature 1..58: note = nucleic acid sequence
  source 1..58: mol_type = other DNA
ttccagctctttatttcgtttttatcagttcttcggtcttcgaggctttatttcctct

SEQ ID NO: 242 - DNA, 50 bp, synthetic construct
  misc_feature 1..50: note = nucleic acid sequence
  source 1..50: mol_type = other DNA
tagtggtcgttcatttaggttttgtgcaattcgagaaagtttggactcct

SEQ ID NO: 243 - DNA, 47 bp, synthetic construct
  misc_feature 1..47: note = nucleic acid sequence
  source 1..47: mol_type = other DNA
ttgttccagttgggcgctggcaagtgtttcccccttttgctcgtcct

SEQ ID NO: 244 - DNA, 57 bp, synthetic construct
  misc_feature 1..57: note = nucleic acid sequence
  source 1..57: mol_type = other DNA
ttagaccgagatagggttgttaatatttacccactcttaatgtcaattcgtcaatat

SEQ ID NO: 245 - DNA, 76 bp, synthetic construct
  misc_feature 1..76: note = nucleic acid sequence
  source 1..76: mol_type = other DNA
ttcagggttattgtctcttccactacttcatgccatttaagtaagttgacccacgttcttgaagtttgttgtagtt

SEQ ID NO: 246 - DNA, 38 bp, synthetic construct
  misc_feature 1..38: note = nucleic acid sequence
  source 1..38: mol_type = other DNA
ttgcttttttgcaaaaaattgatacatatttccccctt

SEQ ID NO: 247 - DNA, 39 bp, synthetic construct
  misc_feature 1..39: note = nucleic acid sequence
  source 1..39: mol_type = other DNA
ttaataccgttcgatgtatttttgttaattccataggct

SEQ ID NO: 248 - DNA, 38 bp, synthetic construct
  misc_feature 1..38: note = nucleic acid sequence
  source 1..38: mol_type = other DNA
tttggccgcttcaacagatttgagtggcaccttccagt

SEQ ID NO: 249 - DNA, 56 bp, synthetic construct
  misc_feature 1..56: note = nucleic acid sequence
  source 1..56: mol_type = other DNA
taaaagcggttctcaaccttatctcagcttgcagattttacctccctttcaaacct

SEQ ID NO: 250 - DNA, 67 bp, synthetic construct
  misc_feature 1..67: note = nucleic acid sequence
  source 1..67: mol_type = other DNA
tggcgagttttcggcgacttcagttaccttagaagatctttctagttatttgccaaaaccgcatcat

SEQ ID NO: 251 - DNA, 50 bp, synthetic construct
  misc_feature 1..50: note = nucleic acid sequence
  source 1..50: mol_type = other DNA
taggcacctttaagtcatttttgggtgagttacaaatagttacccgacat

SEQ ID NO: 252 - DNA, 56 bp, synthetic construct
  misc_feature 1..56: note = nucleic acid sequence
  source 1..56: mol_type = other DNA
taatgcttatttcctcgcttcacgccgtaggtcagttgatgccctttctgctggtt

SEQ ID NO: 253 - DNA, 48 bp, synthetic construct
  misc_feature 1..48: note = nucleic acid sequence
  source 1..48: mol_type = other DNA
taaaactcttatccagttttcgccacatttcaaaagaattcgtaacct

SEQ ID NO: 254 - DNA, 62 bp, synthetic construct
  misc_feature 1..62: note = nucleic acid sequence
  source 1..62: mol_type = other DNA
tttttggaaccgtaaaaaggccgcgttgctgttgtgagcaattctgttgagttacgttaagt

SEQ ID NO: 255 - DNA, 59 bp, synthetic construct
  misc_feature 1..59: note = nucleic acid sequence
  source 1..59: mol_type = other DNA
tttttgcgtggcgctttctcattttctcccttggcggtgtttttcaatattttttgggt

SEQ ID NO: 256 - DNA, 30 bp, synthetic construct
  misc_feature 1..30: note = nucleic acid sequence
  source 1..30: mol_type = other DNA
tttttgtatctcagttcggttttagctcat

SEQ ID NO: 257 - DNA, 66 bp, synthetic construct
  misc_feature 1..66: note = nucleic acid sequence
  source 1..66: mol_type = other DNA
tcaagcttgttaaagtcccataaggtcatttttttttttgtactgggcattcaaaaggccattttt

SEQ ID NO: 258 - DNA, 42 bp, synthetic construct
  misc_feature 1..42: note = nucleic acid sequence
  source 1..42: mol_type = other DNA
tttttcgagctcggtacttgtcatgagattatcaaaattttt

SEQ ID NO: 259 - DNA, 48 bp, synthetic construct
  misc_feature 1..48: note = nucleic acid sequence
  source 1..48: mol_type = other DNA
ttttttttctgggctgtgtgttcttttatctgcgctctgctgattttt

SEQ ID NO: 260 - DNA, 38 bp, synthetic construct
  misc_feature 1..38: note = nucleic acid sequence
  source 1..38: mol_type = other DNA
tttttgctcctggacgtttcagttaatttctagatcct

SEQ ID NO: 261 - DNA, 65 bp, synthetic construct
  misc_feature 1..65: note = nucleic acid sequence
  source 1..65: mol_type = other DNA
ttttttttccgaccgctgcgccttatttcggccatgatatagacgttttcagcttttgcaatgat

SEQ ID NO: 262 - DNA, 50 bp, synthetic construct
  misc_feature 1..50: note = nucleic acid sequence
  source 1..50: mol_type = other DNA
tttttcgcttctcgttggggttcaggaccattctacaggttttaatgtct

SEQ ID NO: 263 - DNA, 44 bp, synthetic construct
  misc_feature 1..44: note = nucleic acid sequence
  source 1..44: mol_type = other DNA
tttttcttgagtccaacccggttggcacgggggattcttctgct

SEQ ID NO: 264 - DNA, 42 bp, synthetic construct
  misc_feature 1..42: note = nucleic acid sequence
  source 1..42: mol_type = other DNA
ttttttcagaagccatagagcccaccgcatcttcgccgcgct

SEQ ID NO: 265 - DNA, 69 bp, synthetic construct
  misc_feature 1..69: note = nucleic acid sequence
  source 1..69: mol_type = other DNA
tttttgcagcagccactggtattgaggtgccgtattgaatttaagacacgacttatcgccactgttttt

SEQ ID NO: 266 - DNA, 33 bp, synthetic construct
  misc_feature 1..33: note = nucleic acid sequence
  source 1..33: mol_type = other DNA
tttttcaataggccgattacattccgccttttt

SEQ ID NO: 267 - DNA, 43 bp, synthetic construct
  misc_feature 1..43: note = nucleic acid sequence
  source 1..43: mol_type = other DNA
tttttttcggggcgaaaactcttcattggaaaacgttcttttt

SEQ ID NO: 268 - DNA, 75 bp, synthetic construct
  misc_feature 1..75: note = nucleic acid sequence
  source 1..75: mol_type = other DNA
tttttgaagtggtggccttgtcttacaggattagcagagttttttttttcgaggtatgtattttcgggaattttt

SEQ ID NO: 269 - DNA, 77 bp, synthetic construct
  misc_feature 1..77: note = nucleic acid sequence
  source 1..77: mol_type = other DNA
ttaatttggcagcactgcatttacgatacttggtagctcttttggaaagtcccgttggtcgttcgctccaagttttt

SEQ ID NO: 270 - DNA, 43 bp, synthetic construct
  misc_feature 1..43: note = nucleic acid sequence
  source 1..43: mol_type = other DNA
tgtgctcattttcaaggattatcagctcattttttaacttttt

SEQ ID NO: 271 - DNA, 64 bp, synthetic construct
  misc_feature 1..64: note = nucleic acid sequence
  source 1..64: mol_type = other DNA
ttgtcacgcttagagtaagttcagggcggttttgccgtcgtccttgaagaagatggtgcttttt

SEQ ID NO: 272 - DNA, 33 bp, synthetic construct
  misc_feature 1..33: note = nucleic acid sequence
  source 1..33: mol_type = other DNA
tttttgttgttgccattgtttgtgatcgttttt

SEQ ID NO: 273 - DNA, 45 bp, synthetic construct
  misc_feature 1..45: note = nucleic acid sequence
  source 1..45: mol_type = other DNA
tttttacagtatttggtttaccttcggctacactagaagattttt

SEQ ID NO: 274 - DNA, 36 bp, synthetic construct
  misc_feature 1..36: note = nucleic acid sequence
  source 1..36: mol_type = other DNA
tatctggccttttgtttccggtaactatcgtttttt

SEQ ID NO: 275 - DNA, 47 bp, synthetic construct
  misc_feature 1..47: note = nucleic acid sequence
  source 1..47: mol_type = other DNA
tccagtgctttgccgtaggtggcattgaaccccccgttcagcttttt

SEQ ID NO: 276 - DNA, 46 bp, synthetic construct
  misc_feature 1..46: note = nucleic acid sequence
  source 1..46: mol_type = other DNA
ttagttcgcttagccttcgttgcggccgttactagtggatcttttt

SEQ ID NO: 277 - DNA, 35 bp, synthetic construct
  misc_feature 1..35: note = nucleic acid sequence
  source 1..35: mol_type = other DNA
tttttaggatcttcacttagtttgcgcaacttttt

SEQ ID NO: 278 - DNA, 30 bp, synthetic construct
  misc_feature 1..30: note = nucleic acid sequence
  source 1..30: mol_type = other DNA
tttttagccagttacttcgctgtagttttt

SEQ ID NO: 279 - DNA, 29 bp, synthetic construct
  misc_feature 1..29: note = nucleic acid sequence
  source 1..29: mol_type = other DNA
tcttcggaattctacagagttcttttttt

SEQ ID NO: 280 - DNA, 39 bp, synthetic construct
  misc_feature 1..39: note = nucleic acid sequence
  source 1..39: mol_type = other DNA
ggcaaaatcccttatagagcaaaattaatttcccaatcc

SEQ ID NO: 281 - DNA, 38 bp, synthetic construct
  misc_feature 1..38: note = nucleic acid sequence
  source 1..38: mol_type = other DNA
agctcattttttaacaaagggaaccaagctcccacccc

SEQ ID NO: 282 - DNA, 37 bp, synthetic construct
  misc_feature 1..37: note = nucleic acid sequence
  source 1..37: mol_type = other DNA
gtgccacctaaattggaagcattgatggataggaaag

SEQ ID NO: 283 - DNA, 38 bp, synthetic construct
  misc_feature 1..38: note = nucleic acid sequence
  source 1..38: mol_type = other DNA
cacatttcacttggaaatccccgatggtaatacttgtg

SEQ ID NO: 284 - DNA, 30 bp, synthetic construct
  misc_feature 1..30: note = nucleic acid sequence
  source 1..30: mol_type = other DNA
acaggaagagatccagttcgattcggtcct

SEQ ID NO: 285 - DNA, 30 bp, synthetic construct
  misc_feature 1..30: note = nucleic acid sequence
  source 1..30: mol_type = other DNA
tactcttcaaagtgctcatcattgcactgc

SEQ ID NO: 286 - DNA, 40 bp, synthetic construct
  misc_feature 1..40: note = nucleic acid sequence
  source 1..40: mol_type = other DNA
atatttgagaccgagttgctcttgactcaaccattaattg

SEQ ID NO: 287 - DNA, 54 bp, synthetic construct
  misc_feature 1..54: note = nucleic acid sequence
  source 1..54: mol_type = other DNA
cccaactgatcttcatcaatgttgtgcaaaaaagcggttagctcctgtaaccca

SEQ ID NO: 288 - DNA, 32 bp, synthetic construct
  misc_feature 1..32: note = nucleic acid sequence
  source 1..32: mol_type = other DNA
ccgctgttggcaaaatgccgcaaacaataggc

SEQ ID NO: 289 - DNA, 39 bp, synthetic construct
  misc_feature 1..39: note = nucleic acid sequence
  source 1..39: mol_type = other DNA
ggcgaaaactctcaaggccgcagctcgtcgtttggtatg

SEQ ID NO: 290 - DNA, 32 bp, synthetic construct
  misc_feature 1..32: note = nucleic acid sequence
  source 1..32: mol_type = other DNA
ttcttcgggacacggaaatgttgaaaattttt

SEQ ID NO: 291 - DNA, 32 bp, synthetic construct
  misc_feature 1..32: note = nucleic acid sequence
  source 1..32: mol_type = other DNA
gaactttactttttcaatattatttaagcgtt

SEQ ID NO: 292 - DNA, 54 bp, synthetic construct
  misc_feature 1..54: note = nucleic acid sequence
  source 1..54: mol_type = other DNA
ccgcgccaccgtaaggttcgccagttaatactccagatatagaatagttcacct

SEQ ID NO: 293 - DNA, 32 bp, synthetic construct
  misc_feature 1..32: note = nucleic acid sequence
  source 1..32: mol_type = other DNA
actcatggttatggcaggaaaacgacctactc

SEQ ID NO: 294 - DNA, 38 bp, synthetic construct
  misc_feature 1..38: note = nucleic acid sequence
  source 1..38: mol_type = other DNA
catgccatcatagcaattttattatctgcacgtaggtg

SEQ ID NO: 295 - DNA, 40 bp, synthetic construct
  misc_feature 1..40: note = nucleic acid sequence
  source 1..40: mol_type = other DNA
ggttcccaacgatcaacctgactcgcgcttctcagcagca

SEQ ID NO: 296 - DNA, 54 bp, synthetic construct
  misc_feature 1..54: note = nucleic acid sequence
  source 1..54: mol_type = other DNA
cagctccccgatcgttgtcagaagtaagttggatcttatgccccactgggtctc

SEQ ID NO: 297 - DNA, 38 bp, synthetic construct
  misc_feature 1..38: note = nucleic acid sequence
  source 1..38: mol_type = other DNA
tgccattgctacagggcaatgatgctcgtctgccgtcc

SEQ ID NO: 298 - DNA, 39 bp, synthetic construct
  misc_feature 1..39: note = nucleic acid sequence
  source 1..39: mol_type = other DNA
gaagctaggagtggcatcaatacggttattgtctcatga

SEQ ID NO: 299 - DNA, 37 bp, synthetic construct
  misc_feature 1..37: note = nucleic acid sequence
  source 1..37: mol_type = other DNA
ttgccggcggaagggatcagcggccatgatgcccttc

SEQ ID NO: 300 - DNA, 52 bp, synthetic construct
  misc_feature 1..52: note = nucleic acid sequence
  source 1..52: mol_type = other DNA
atagttgggcgagtgcctgctctcgtgcaccagcgtttctgggtaatcaaaa

SEQ ID NO: 301 - DNA, 31 bp, synthetic construct
  misc_feature 1..31: note = nucleic acid sequence
  source 1..31: mol_type = other DNA
gtagataactacgatgcttcatttgctgtcc

SEQ ID NO: 302 - DNA, 32 bp, synthetic construct
  misc_feature 1..32: note = nucleic acid sequence
  source 1..32: mol_type = other DNA
gacccacgctcaccgggtttgcgcatttcctc

SEQ ID NO: 303 - DNA, 38 bp, synthetic construct
  misc_feature 1..38: note = nucleic acid sequence
  source 1..38: mol_type = other DNA
agtatattctggccccagtgctcatcgtggagaatgac

SEQ ID NO: 304 - DNA, 39 bp, synthetic construct
  misc_feature 1..39: note = nucleic acid sequence
  source 1..39: mol_type = other DNA
atccttttatcttgaagggccctcagcttgcgaattcca

SEQ ID NO: 305 - DNA, 46 bp, synthetic construct
  misc_feature 1..46: note = nucleic acid sequence
  source 1..46: mol_type = other DNA
ctgaagcaactacggctacactaccccctggaagaagtcgacgtca

SEQ ID NO: 306 - DNA, 39 bp, synthetic construct
  misc_feature 1..39: note = nucleic acid sequence
  source 1..39: mol_type = other DNA
ttcggaaaaagagtttgacagtttgggggtgaactccag

SEQ ID NO: 307 - DNA, 48 bp, synthetic construct
  misc_feature 1..48: note = nucleic acid sequence
  source 1..48: mol_type = other DNA
ggtagctccggtgctacagagttcttccgaccctggacgtctatggga

SEQ ID NO: 308 - DNA, 39 bp, synthetic construct
  misc_feature 1..39: note = nucleic acid sequence
  source 1..39: mol_type = other DNA
ttgatccggcaaacaaaccaccgcaatctaactgcacgc

SEQ ID NO: 309 - DNA, 30 bp, synthetic construct
  misc_feature 1..30: note = nucleic acid sequence
  source 1..30: mol_type = other DNA
gccactgggtggtttttttgtttgcaagca

SEQ ID NO: 310 - DNA, 38 bp, synthetic construct
  misc_feature 1..38: note = nucleic acid sequence
  source 1..38: mol_type = other DNA
acgacttatcgccactctcatatcgaacttgggccatt

SEQ ID NO: 311 - DNA, 54 bp, synthetic construct
  misc_feature 1..54: note = nucleic acid sequence
  source 1..54: mol_type = other DNA
ggtaagaccgcgcagaaaaaaaggatctcaacatgagatgcttgtcgagctcta

SEQ ID NO: 312 - DNA, 37 bp, synthetic construct
  misc_feature 1..37: note = nucleic acid sequence
  source 1..37: mol_type = other DNA
aactatcgtcttgagcggtgtaagctcgaactccata

SEQ ID NO: 313 - DNA, 36 bp, synthetic construct
  misc_feature 1..36: note = nucleic acid sequence
  source 1..36: mol_type = other DNA
tcgtgcgctctcctgttgaagttcgccgaaccaatg

SEQ ID NO: 314 - DNA, 48 bp, synthetic construct
  misc_feature 1..48: note = nucleic acid sequence
  source 1..48: mol_type = other DNA
tctcagtttccaacccgttcttcttatcaaaacaataaaccagccagc

SEQ ID NO: 315 - DNA, 47 bp, synthetic construct
  misc_feature 1..47: note = nucleic acid sequence
  source 1..47: mol_type = other DNA
ggtcgttccaatgagtgagcaaaaggccagcaacgcggatgcggttc

SEQ ID NO: 316 - DNA, 30 bp, synthetic construct
  misc_feature 1..30: note = nucleic acid sequence
  source 1..30: mol_type = other DNA
ctataaacacccattgtgctgcttcatgct

SEQ ID NO: 317 - DNA, 54 bp, synthetic construct
  misc_feature 1..54: note = nucleic acid sequence
  source 1..54: mol_type = other DNA
aatcgacgctcaagtcggcgttaagccttcgggtcagggcaggaccatccccct

SEQ ID NO: 318 - DNA, 38 bp, synthetic construct
  misc_feature 1..38: note = nucleic acid sequence
  source 1..38: mol_type = other DNA
gacgagcttaccggatacctgtcagcgaggtcggcgag

SEQ ID NO: 319 - DNA, 48 bp, synthetic construct
  misc_feature 1..48: note = nucleic acid sequence
  source 1..48: mol_type = other DNA
gctggcgtgggaagcgtggcgctttggcagcatgtggcggaaattaaa

SEQ ID NO: 320 - DNA, 39 bp, synthetic construct
  misc_feature 1..39: note = nucleic acid sequence
  source 1..39: mol_type = other DNA
tatgaactgcgtatatgctccaagctgggctctgcgcct

SEQ ID NO: 321 - DNA, 39 bp, synthetic construct
  misc_feature 1..39: note = nucleic acid sequence
  source 1..39: mol_type = other DNA
gatgtactgccaagtggagctctgagtgggttactttca

SEQ ID NO: 322 - DNA, 31 bp, synthetic construct
  misc_feature 1..31: note = nucleic acid sequence
  source 1..31: mol_type = other DNA
atagggggcgtacttgacgcctagagtcgta

SEQ ID NO: 323 - DNA, 30 bp, synthetic construct
  misc_feature 1..30: note = nucleic acid sequence
  source 1..30: mol_type = other DNA
gccatttagagttgtgctcggtataagggc

SEQ ID NO: 324 - DNA, 31 bp, synthetic construct
  misc_feature 1..31: note = nucleic acid sequence
  source 1..31: mol_type = other DNA
gtcccataaggtcattgattttggcacactg

SEQ ID NO: 325 - DNA, 31 bp, synthetic construct
  misc_feature 1..31: note = nucleic acid sequence
  source 1..31: mol_type = other DNA
caaaaccgcatcacctgagtcaactcctcgc

SEQ ID NO: 326 - DNA, 54 bp, synthetic construct
  misc_feature 1..54: note = nucleic acid sequence
  source 1..54: mol_type = other DNA
ttgcgtcaatggggcgccgtcattgccagggcgaagatggtagtggtatgtagg

SEQ ID NO: 327 - DNA, 46 bp, synthetic construct
  misc_feature 1..46: note = nucleic acid sequence
  source 1..46: mol_type = other DNA
tttggaaagtcccgtgtactggggatgaactcgcgggtctcgatgt

SEQ ID NO: 328 - DNA, 53 bp, synthetic construct
  misc_feature 1..53: note = nucleic acid sequence
  source 1..53: mol_type = other DNA
gtgccaaaaatattttgttaaaattcgcgttatactcagcggccgtagacaat

SEQ ID NO: 329 - DNA, 45 bp, synthetic construct
  misc_feature 1..45: note = nucleic acid sequence
  source 1..45: mol_type = other DNA
acaaactcccattgaactgccaagcatcgcaccagggttgatgcc

SEQ ID NO: 330 - DNA, 37 bp, synthetic construct
  misc_feature 1..37: note = nucleic acid sequence
  source 1..37: mol_type = other DNA
tactagtgtggtgcacataatgggtcgttgggcggtc

SEQ ID NO: 331 - DNA, 31 bp, synthetic construct
  misc_feature 1..31: note = nucleic acid sequence
  source 1..31: mol_type = other DNA
gagggtgggacgtcaacatacgtcattattg

SEQ ID NO: 332 - DNA, 62 bp, synthetic construct
  misc_feature 1..62: note = nucleic acid sequence
  source 1..62: mol_type = other DNA
cctcgcccgcatttaggacagtggagtaagtaatgcttttctgtgactggtgagtcccggcg

SEQ ID NO: 333 - DNA, 44 bp, synthetic construct
  misc_feature 1..44: note = nucleic acid sequence
  source 1..44: mol_type = other DNA
ttgtagttcccttcttttccataggctccgcccccctacgtcaa

SEQ ID NO: 334 - DNA, 46 bp, synthetic construct
  misc_feature 1..46: note = nucleic acid sequence
  source 1..46: mol_type = other DNA
gtcgcccgctcacgcaggaaccgtaaaaaggccgcgttagccaggc

SEQ ID NO: 335 - DNA, 31 bp, synthetic construct
  misc_feature 1..31: note = nucleic acid sequence
  source 1..31: mol_type = other DNA
tcctccttgccgtttaggcacaggaaggcac

SEQ ID NO: 336 - DNA, 53 bp, synthetic construct
  misc_feature 1..53: note = nucleic acid sequence
  source 1..53: mol_type = other DNA
cgttggggcggctgacagtaagccttatatgaatagaccgagatagggttgtt

SEQ ID NO: 337 - DNA, 31 bp, synthetic construct
  misc_feature 1..31: note = nucleic acid sequence
  source 1..31: mol_type = other DNA
tgtgatccccgtcgtcttaatcagtgaggca

SEQ ID NO: 338 - DNA, 32 bp, synthetic construct
  misc_feature 1..32: note = nucleic acid sequence
  source 1..32: mol_type = other DNA
ccggcggcgcttaccaatgagtaaacttggtc

SEQ ID NO: 339 - DNA, 38 bp, synthetic construct
  misc_feature 1..38: note = nucleic acid sequence
  source 1..38: mol_type = other DNA
gtgacactttatcagaggatcttcacctaggcagatta

SEQ ID NO: 340 - DNA, 39 bp, synthetic construct
  misc_feature 1..39: note = nucleic acid sequence
  source 1..39: mol_type = other DNA
tcgaggctgccgagcgttaagggattttggtgaagatcc

SEQ ID NO: 341 - DNA, 55 bp, synthetic construct
  misc_feature 1..55: note = nucleic acid sequence
  source 1..55: mol_type = other DNA
attgtcttcgataagcagcactgcatacacttatggaaagtccctattagaggtg

SEQ ID NO: 342 - DNA, 47 bp, synthetic construct
  misc_feature 1..47: note = nucleic acid sequence
  source 1..47: mol_type = other DNA
gcatcttttctctagtaccgcatccagggcgcccatttcgttcatcc

SEQ ID NO: 343 - DNA, 46 bp, synthetic construct
  misc_feature 1..46: note = nucleic acid sequence
  source 1..46: mol_type = other DNA
acgggaggggtcacgttctgctggtgcgctcctgccgcatcacaaa

SEQ ID NO: 344 - DNA, 40 bp, synthetic construct
  misc_feature 1..40: note = nucleic acid sequence
  source 1..40: mol_type = other DNA
attagcagcgcctttctgccgtcgtgggcgggccaggcgg

SEQ ID NO: 345 - DNA, 39 bp, synthetic construct
  misc_feature 1..39: note = nucleic acid sequence
  source 1..39: mol_type = other DNA
gtaggaaataccgtaagttatgtaaaaggcctgtaggta

SEQ ID NO: 346 - DNA, 47 bp, synthetic construct
  misc_feature 1..47: note = nucleic acid sequence
  source 1..47: mol_type = other DNA
ctaatacgtagatgtcgtcaatgcgccagtgttatcaggggataata

SEQ ID NO: 347 - DNA, 62 bp, synthetic construct
  misc_feature 1..62: note = nucleic acid sequence
  source 1..62: mol_type = other DNA
agacctcccaccgtacgcatatgacgccgtaggcatggcggggccgggtggcctcagttacc

SEQ ID NO: 348 - DNA, 30 bp, synthetic construct
  misc_feature 1..30: note = nucleic acid sequence
  source 1..30: mol_type = other DNA
tggtcaccctatagtccgcccatcgaaatc

SEQ ID NO: 349 - DNA, 31 bp, synthetic construct
  misc_feature 1..31: note = nucleic acid sequence
  source 1..31: mol_type = other DNA
tcgccggagagcggcgggtggagcccgaaaa

SEQ ID NO: 350 - DNA, 32 bp, synthetic construct
  misc_feature 1..32: note = nucleic acid sequence
  source 1..32: mol_type = other DNA
cggacttgaagctcccgcgaaacccgacagga

SEQ ID NO: 351 - DNA, 44 bp, synthetic construct
  misc_feature 1..44: note = nucleic acid sequence
  source 1..44: mol_type = other DNA
tccttgaaacgggcagagtgatcccagaattgtcacgtgttatc

SEQ ID NO: 352 - DNA, 55 bp, synthetic construct
  misc_feature 1..55: note = nucleic acid sequence
  source 1..55: mol_type = other DNA
cacctcggtcagggtctagattagcgatgcaaacgttgtataattctcttactgt

SEQ ID NO: 353 - DNA, 40 bp, synthetic construct
  misc_feature 1..40: note = nucleic acid sequence
  source 1..40: mol_type = other DNA
catgccgagcttgccgggatccgatacgacatgttaaatc

SEQ ID NO: 354 - DNA, 46 bp, synthetic construct
  misc_feature 1..46: note = nucleic acid sequence
  source 1..46: mol_type = other DNA
cttgtacaaccgcgaaatgaagttttaaatctggtagcgtaacagg

SEQ ID NO: 355 - DNA, 38 bp, synthetic construct
  misc_feature 1..38: note = nucleic acid sequence
  source 1..38: mol_type = other DNA
ccttccaaccatctccacgctgaagcgatgatatgggc

SEQ ID NO: 356 - DNA, 55 bp, synthetic construct
  misc_feature 1..55: note = nucleic acid sequence
  source 1..55: mol_type = other DNA
tttttaaaaataaacaaataggggttccgcggcggatacccttgctcgggtcaag

SEQ ID NO: 357 - DNA, 50 bp, synthetic construct
  misc_feature 1..50: note = nucleic acid sequence
  source 1..50: mol_type = other DNA
ttttttattaaagaacgtggaggaacaagcgggcgtagccagaggcagtt

SEQ ID NO: 358 - DNA, 27 bp, synthetic construct
  misc_feature 1..27: note = nucleic acid sequence
  source 1..27: mol_type = other DNA
tttttgcgaaaaaccgtctactccaac

SEQ ID NO: 359 - DNA, 61 bp, synthetic construct
  misc_feature 1..61: note = nucleic acid sequence
  source 1..61: mol_type = other DNA
tccagtctaagtcattctgagaatagtttttttttttgtatgcggcatgtatttagttttt

SEQ ID NO: 360 - DNA, 40 bp, synthetic construct
  misc_feature 1..40: note = nucleic acid sequence
  source 1..40: mol_type = other DNA
ttttttatccgcctccagggggaggggcaaacaacttttt

SEQ ID NO: 361 - DNA, 41 bp, synthetic construct
  misc_feature 1..41: note = nucleic acid sequence
  source 1..41: mol_type = other DNA
tttttcgtgaaccatcagacaatgtcacattccgccttttt

SEQ ID NO: 362 - DNA, 33 bp, synthetic construct
  misc_feature 1..33: note = nucleic acid sequence
  source 1..33: mol_type = other DNA
tttttcagtggaacgaagttgtagtaactagaa

SEQ ID NO: 363 - DNA, 55 bp, synthetic construct
  misc_feature 1..55: note = nucleic acid sequence
  source 1..55: mol_type = other DNA
tttttggtcgaggtgccgtaaaatttggtatctgcgctctgcctatcttgtcggg

SEQ ID NO: 364 - DNA, 43 bp, synthetic construct
  misc_feature 1..43: note = nucleic acid sequence
  source 1..43: mol_type = other DNA
tttttcgttcagcccgaccggtgtgcacgttgccgcgtaattg

SEQ ID NO: 365 - DNA, 39 bp, synthetic construct
  misc_feature 1..39: note = nucleic acid sequence
  source 1..39: mol_type = other DNA
tttttcctaaagggagcccccaccaggcgtttgaagaac

SEQ ID NO: 366 - DNA, 39 bp, synthetic construct
  misc_feature 1..39: note = nucleic acid sequence
  source 1..39: mol_type = other DNA
tttttataactagtcaataatcaatgtcaacaatgaccc

SEQ ID NO: 367 - DNA, 63 bp, synthetic construct
  misc_feature 1..63: note = nucleic acid sequence
  source 1..63: mol_type = other DNA
tttttccggcgaacgtggcgacgtaaatactcgatgatttagagcttgacggggaaagttttt

SEQ ID NO: 368 - DNA, 31 bp, synthetic construct
  misc_feature 1..31: note = nucleic acid sequence
  source 1..31: mol_type = other DNA
ttttttgatgtactgcattactattattttt

SEQ ID NO: 369 - DNA, 41 bp, synthetic construct
  misc_feature 1..41: note = nucleic acid sequence
  source 1..41: mol_type = other DNA
tttttatgggcaccaccccggtccagctcgaccaggttttt

SEQ ID NO: 370 - DNA, 69 bp, synthetic construct
  misc_feature 1..69: note = nucleic acid sequence
  source 1..69: mol_type = other DNA
tttttaagtgtagcggttacgaaaggaagggaagattttttttttaagcgaaaggagagtccacttttt

SEQ ID NO: 371 - DNA, 66 bp, synthetic construct
  misc_feature 1..66: note = nucleic acid sequence
  source 1..66: mol_type = other DNA
cacgtggtcggggtagtctttgctcccagcattacatgatcccccgggcgatggcccactattttt

SEQ ID NO: 372 - DNA, 38 bp, synthetic construct
  misc_feature 1..38: note = nucleic acid sequence
  source 1..38: mol_type = other DNA
cgtcgccgtgaacagaccgctatccacgcccatttttt

SEQ ID NO: 373 - DNA, 57 bp, synthetic construct
  misc_feature 1..57: note = nucleic acid sequence
  source 1..57: mol_type = other DNA
gaagtcgatatagacgtatccggttttgatcttttctacggggtctgacgctttttt

SEQ ID NO: 374 - DNA, 31 bp, synthetic construct
  misc_feature 1..31: note = nucleic acid sequence
  source 1..31: mol_type = other DNA
ttttttgtgccccaggatgaacccccttttt

SEQ ID NO: 375 - DNA, 41 bp, synthetic construct
  misc_feature 1..41: note = nucleic acid sequence
  source 1..41: mol_type = other DNA
tttttcccgccgcgctttgggcgcgtaaccaccacattttt

SEQ ID NO: 376 - DNA, 31 bp, synthetic construct
  misc_feature 1..31: note = nucleic acid sequence
  source 1..31: mol_type = other DNA
gtgctcagagtgcactaaatcggaacttttt

SEQ ID NO: 377 - DNA, 42 bp, synthetic construct
  misc_feature 1..42: note = nucleic acid sequence
  source 1..42: mol_type = other DNA
gtagtggtcagcgatctgtcttaatcaagttttttggttttt

SEQ ID NO: 378 - DNA, 41 bp, synthetic construct
  misc_feature 1..41: note = nucleic acid sequence
  source 1..41: mol_type = other DNA
ttgtggctaactcacgcagaagtggtcctgcaacttttttt

SEQ ID NO: 379 - DNA, 33 bp, synthetic construct
  misc_feature 1..33: note = nucleic acid sequence
  source 1..33: mol_type = other DNA
tttttagatggctggctgtactccagctttttt

SEQ ID NO: 380 - DNA, 28 bp, synthetic construct
  misc_feature 1..28: note = nucleic acid sequence
  source 1..28: mol_type = other DNA
ttttttcagaagccagtcaaaggttttt

SEQ ID NO: 381 - DNA, 26 bp, synthetic construct
  misc_feature 1..26: note = nucleic acid sequence
  source 1..26: mol_type = other DNA
tagagcccctagggcgctggcttttt

SEQ ID NO: 382 - DNA, 47 bp, synthetic construct
  misc_feature 1..47: note = nucleic acid sequence
  source 1..47: mol_type = other DNA
tggcaaaatcccttatattgagcaaaattttaatttttcccaatcct

SEQ ID NO: 383 - DNA, 46 bp, synthetic construct
  misc_feature 1..46: note = nucleic acid sequence
  source 1..46: mol_type = other DNA
tagctcattttttaacttaaagggaattccaagctttcccacccct

SEQ ID NO: 384 - DNA, 45 bp, synthetic construct
  misc_feature 1..45: note = nucleic acid sequence
  source 1..45: mol_type = other DNA
tgtgccacctaaattgttgaagcattttgatggatttaggaaagt

SEQ ID NO: 385 - DNA, 46 bp, synthetic construct
  misc_feature 1..46: note = nucleic acid sequence
  source 1..46: mol_type = other DNA
tcacatttcttacttggaaatccccgttatggtaatttacttgtgt

SEQ ID NO: 386 - DNA, 36 bp, synthetic construct
  misc_feature 1..36: note = nucleic acid sequence
  source 1..36: mol_type = other DNA
tacaggaattgagatccagttcgattttcggtcctt

SEQ ID NO: 387 - DNA, 36 bp, synthetic construct
  misc_feature 1..36: note = nucleic acid sequence
  source 1..36: mol_type = other DNA
ttactcttcttaaagtgctcatcattttgcactgct

SEQ ID NO: 388 - DNA, 48 bp, synthetic construct
  misc_feature 1..48: note = nucleic acid sequence
  source 1..48: mol_type = other DNA
tatatttgattgaccgagttgctcttgttactcaaccttattaattgt

SEQ ID NO: 389 - DNA, 62 bp, synthetic construct
  misc_feature 1..62: note = nucleic acid sequence
  source 1..62: mol_type = other DNA
tcccaactgatcttcatttcattatgttgtgcaaaaaagcggttagctcctttgtaacccat

SEQ ID NO: 390 - DNA, 38 bp, synthetic construct
  misc_feature 1..38: note = nucleic acid sequence
  source 1..38: mol_type = other DNA
tccgctgttttggcaaaatgccgcaaattcaataggct

SEQ ID NO: 391 - DNA, 45 bp, synthetic construct
  misc_feature 1..45: note = nucleic acid sequence
  source 1..45: mol_type = other DNA
tggcgaaaactctcaattggccgcagttctcgtcgtttggtatgt

SEQ ID NO: 392 - DNA, 38 bp, synthetic construct
  misc_feature 1..38: note = nucleic acid sequence
  source 1..38: mol_type = other DNA
tttcttcggttgacacggaaatgttgattaaatttttt

SEQ ID NO: 393 - DNA, 38 bp, synthetic construct
  misc_feature 1..38: note = nucleic acid sequence
  source 1..38: mol_type = other DNA
tgaactttattctttttcaatattatttttaagcgttt

SEQ ID NO: 394 - DNA, 66 bp, synthetic construct
  misc_feature 1..66: note = nucleic acid sequence
  source 1..66: mol_type = other DNA
tccgcgccattccgtaagttgttcgccagttaatattctccagatttatagaatattgttcacctt

SEQ ID NO: 395 - DNA, 38 bp, synthetic construct
  misc_feature 1..38: note = nucleic acid sequence
  source 1..38: mol_type = other DNA
tactcatggttatggcattggaaaacgttacctactct

SEQ ID NO: 396 - DNA, 48 bp, synthetic construct
  misc_feature 1..48: note = nucleic acid sequence
  source 1..48: mol_type = other DNA
tcatgccatttcatagcattattttattttatctgcattcgtaggtgt

SEQ ID NO: 397 - DNA, 48 bp, synthetic construct
  misc_feature 1..48: note = nucleic acid sequence
  source 1..48: mol_type = other DNA
tggttcccaacgatcaattcctgactcttgcgcttctttcagcagcat

SEQ ID NO: 398 - DNA, 64 bp, synthetic construct
  misc_feature 1..64: note = nucleic acid sequence
  source 1..64: mol_type = other DNA
tcagctccttccgatcgttgtcagaagtaagttttggatcttatttgccccactttgggtctct

SEQ ID NO: 399 - DNA, 46 bp, synthetic construct
  misc_feature 1..46: note = nucleic acid sequence
  source 1..46: mol_type = other DNA
ttgccattgctacaggttgcaatgatttgctcgtctttgccgtcct

SEQ ID NO: 400 - DNA, 47 bp, synthetic construct
  misc_feature 1..47: note = nucleic acid sequence
  source 1..47: mol_type = other DNA
tgaagctagttgagtggcatttcaatacgttgttattgtctcatgat

SEQ ID NO: 401 - DNA, 47 bp, synthetic construct
  misc_feature 1..47: note = nucleic acid sequence
  source 1..47: mol_type = other DNA
tttgccggttcggaaggttgatcagcgttgccatgatttgcccttct

SEQ ID NO: 402 - DNA, 64 bp, synthetic construct
  misc_feature 1..64: note = nucleic acid sequence
  source 1..64: mol_type = other DNA
tatagttgttggcgagtttgcctgctttctcgtgcattccagcgtttctgggtttaatcaaaat

SEQ ID NO: 403 - DNA, 37 bp, synthetic construct
  misc_feature 1..37: note = nucleic acid sequence
  source 1..37: mol_type = other DNA
tgtagataactacgatttgcttcatttttgctgtcct

SEQ ID NO: 404 - DNA, 38 bp, synthetic construct
  misc_feature 1..38: note = nucleic acid sequence
  source 1..38: mol_type = other DNA
tgacccacgctcaccggttgtttgcgcttatttcctct

SEQ ID NO: 405 - DNA, 46 bp, synthetic construct
  misc_feature 1..46: note = nucleic acid sequence
  source 1..46: mol_type = other DNA
tagtatattttctggccccagtgctttcatcgtggttagaatgact

SEQ ID NO: 406 - DNA, 49 bp, synthetic construct
  misc_feature 1..49: note = nucleic acid sequence
  source 1..49: mol_type = other DNA
tatccttttttatcttgaattgggccctttcagcttgcttgaattccat

SEQ ID NO: 407 - DNA, 56 bp, synthetic construct
  misc_feature 1..56: note = nucleic acid sequence
  source 1..56: mol_type = other DNA
tctgaagcttaactacggctacactattccccctggttaagaagtcttgacgtcat

SEQ ID NO: 408 - DNA, 47 bp, synthetic construct
  misc_feature 1..47: note = nucleic acid sequence
  source 1..47: mol_type = other DNA
tttcggaaaaagagtttttgacagtttttgggggtgttaactccagt

SEQ ID NO: 409 - DNA, 58 bp, synthetic construct
  misc_feature 1..58: note = nucleic acid sequence
  source 1..58: mol_type = other DNA
tggtagctcttcggtgctacagagttcttttccgaccttctggacgtttctatgggat

SEQ ID NO: 410 - DNA, 45 bp, synthetic construct
  misc_feature 1..45: note = nucleic acid sequence
  source 1..45: mol_type = other DNA
tttgatccggcaaacaaaccaccgttcaatctaattctgcacgct

SEQ ID NO: 411 - DNA, 34 bp, synthetic construct
  misc_feature 1..34: note = nucleic acid sequence
  source 1..34: mol_type = other DNA
tgccactgttggtggtttttttgtttgcaagcat

SEQ ID NO: 412 - DNA, 46 bp, synthetic construct
  misc_feature 1..46: note = nucleic acid sequence
  source 1..46: mol_type = other DNA
tacgacttatcgccactttctcatatttcgaacttttgggccattt

SEQ ID NO: 413 - DNA, 64 bp, synthetic construct
  misc_feature 1..64: note = nucleic acid sequence
  source 1..64: mol_type = other DNA
tggtaagacttcgcgcagaaaaaaaggatctcaattcatgagatttgcttgtcgttagctctat

SEQ ID NO: 414 - DNA, 45 bp, synthetic construct
  misc_feature 1..45: note = nucleic acid sequence
  source 1..45: mol_type = other DNA
taactatcgtcttgagttcggtgtattagctcgattactccatat

SEQ ID NO: 415 - DNA, 44 bp, synthetic construct
  misc_feature 1..44: note = nucleic acid sequence
  source 1..44: mol_type = other DNA
ttcgtgcgctctcctgttttgaagttttcgccgattaccaatgt

SEQ ID NO: 416 - DNA, 58 bp, synthetic construct
  misc_feature 1..58: note = nucleic acid sequence
  source 1..58: mol_type = other DNA
ttctcagtttttccaacccttgttcttcttttatcaaaattcaataaaccagccagct

SEQ ID NO: 417 - DNA, 55 bp, synthetic construct
  misc_feature 1..55: note = nucleic acid sequence
  source 1..55: mol_type = other DNA
tggtcgttcttcaatgagtgagcaaaaggccagcttaacgcggatttgcggttct

SEQ ID NO: 418 - DNA, 38 bp, synthetic construct
  misc_feature 1..38: note = nucleic acid sequence
  source 1..38: mol_type = other DNA
tctataaattcacccattttgtgctgcttcatttgctt

SEQ ID NO: 419 - DNA, 66 bp, synthetic construct
  misc_feature 1..66: note = nucleic acid sequence
  source 1..66: mol_type = other DNA
taatcgacgctcaagtcttggcgttattagccttcgttggtcagggttcaggaccatttccccctt

SEQ ID NO: 420 - DNA, 46 bp, synthetic construct
  misc_feature 1..46: note = nucleic acid sequence
  source 1..46: mol_type = other DNA
tgacgagcttttaccggatacctgtcttagcgaggtttcggcgagt

SEQ ID NO: 421 - DNA, 58 bp, synthetic construct
  misc_feature 1..58: note = nucleic acid sequence
  source 1..58: mol_type = other DNA
tgctggcgtttgggaagcgtggcgctttttggcagcatttgtggcggttaaattaaat

SEQ ID NO: 422 - DNA, 49 bp, synthetic construct
  misc_feature 1..49: note = nucleic acid sequence
  source 1..49: mol_type = other DNA
ttatgaactttgcgtttatatttgctccaagctgggctttctgcgcctt

SEQ ID NO: 423 - DNA, 47 bp, synthetic construct
  misc_feature 1..47: note = nucleic acid sequence
  source 1..47: mol_type = other DNA
tgatgtactgccaagtgttgagctctgttagtgggttttactttcat

SEQ ID NO: 424 - DNA, 37 bp, synthetic construct
  misc_feature 1..37: note = nucleic acid sequence
  source 1..37: mol_type = other DNA
tatagggggcgtacttgttacgcctattgagtcgtat

SEQ ID NO: 425 - DNA, 38 bp, synthetic construct
  misc_feature 1..38: note = nucleic acid sequence
  source 1..38: mol_type = other DNA
tgccatttattgagttgtttgctcggtatttaagggct

SEQ ID NO: 426 - DNA, 37 bp, synthetic construct
  misc_feature 1..37: note = nucleic acid sequence
  source 1..37: mol_type = other DNA
tgtcccataaggtcattttgattttgttgcacactgt

SEQ ID NO: 427 - DNA, 37 bp, synthetic construct
  misc_feature 1..37: note = nucleic acid sequence
  source 1..37: mol_type = other DNA
tcaaaaccgcatcacctttgagtcaattctcctcgct

SEQ ID NO: 428 - DNA, 66 bp, synthetic construct
  misc_feature 1..66: note = nucleic acid sequence
  source 1..66: mol_type = other DNA
tttgcgtcaatggggcgttccgtcattttgccagggcttgaagatgttgtagtggtttatgtaggt

SEQ ID NO: 429 - DNA, 56 bp, synthetic construct
  misc_feature 1..56: note = nucleic acid sequence
  source 1..56: mol_type = other DNA
ttttggaaagtcccgtttgtactgggttgatgaactttcgcgggtctttcgatgtt

SEQ ID NO: 430 - DNA, 63 bp, synthetic construct
  misc_feature 1..63: note = nucleic acid sequence
  source 1..63: mol_type = other DNA
tgtgccaaattaatattttgttaaaattcgcgttttatactcattgcggccgtttagacaatt

SEQ ID NO: 431 - DNA, 55 bp, synthetic construct
  misc_feature 1..55: note = nucleic acid sequence
  source 1..55: mol_type = other DNA
tacaaactcccattgattactgccaattgcatcgcttaccagggttttgatgcct

SEQ ID NO: 432 - DNA, 45 bp, synthetic construct
  misc_feature 1..45: note = nucleic acid sequence
  source 1..45: mol_type = other DNA
ttactagtttgtggtgcattcataatgttggtcgttgggcggtct

SEQ ID NO: 433 - DNA, 37 bp, synthetic construct
  misc_feature 1..37: note = nucleic acid sequence
  source 1..37: mol_type = other DNA
tgagggtggttgacgtcattacatacgtcattattgt

SEQ ID NO: 434 - DNA, 74 bp, synthetic construct
  misc_feature 1..74: note = nucleic acid sequence
  source 1..74: mol_type = other DNA
tcctcgcccttgcatttagttgacagtggttagtaagtattatgcttttctgtgactggtgagtttcccggcgt

SEQ ID NO: 435 - DNA, 52 bp, synthetic construct
  misc_feature 1..52: note = nucleic acid sequence
  source 1..52: mol_type = other DNA
tttgtagttttcccttcttttttccataggctccgcccccctttacgtcaat

SEQ ID NO: 436 - DNA, 54 bp, synthetic construct
  misc_feature 1..54: note = nucleic acid sequence
  source 1..54: mol_type = other DNA
tgtcgcccttgctcacgcttaggaaccgtaaaaaggccgcgttttagccaggct

SEQ ID NO: 437 - DNA, 39 bp, synthetic construct
  misc_feature 1..39: note = nucleic acid sequence
  source 1..39: mol_type = other DNA
ttcctccttttgccgtttattggcacagttgaaggcact

SEQ ID NO: 438 - DNA, 65 bp, synthetic construct
  misc_feature 1..65: note = nucleic acid sequence
  source 1..65: mol_type = other DNA
tcgttggggttcggctgattcagtaagcttcttatatttgaatagaccgagatagggttgttttt

SEQ ID NO: 439 - DNA, 37 bp, synthetic construct
  misc_feature 1..37: note = nucleic acid sequence
  source 1..37: mol_type = other DNA
ttgtgatcttcccgtcgtttcttaatcagtgaggcat

SEQ ID NO: 440 - DNA, 38 bp, synthetic construct
  misc_feature 1..38: note = nucleic acid sequence
  source 1..38: mol_type = other DNA
tccggcggcttgcttaccattatgagtaaacttggtct

SEQ ID NO: 441 - DNA, 46 bp, synthetic construct
  misc_feature 1..46: note = nucleic acid sequence
  source 1..46: mol_type = other DNA
tgtgacactttttatcagttaggatcttcacctagttgcagattat

SEQ ID NO: 442 - DNA, 47 bp, synthetic construct
  misc_feature 1..47: note = nucleic acid sequence
  source 1..47: mol_type = other DNA
ttcgaggctttgccgagcgttttaagggattttggtttgaagatcct

SEQ ID NO: 443 - DNA, 67 bp, synthetic construct
  misc_feature 1..67: note = nucleic acid sequence
  source 1..67: mol_type = other DNA
tattgtcttttcgataagcttagcactgcttatacacttttatggaaagtccctattttagaggtgt

SEQ ID NO: 444 - DNA, 60 bp, synthetic construct
  misc_feature 1..60: note = nucleic acid sequence
  source 1..60: mol_type = other DNA
tgcatcttttttctctagtttaccgcatcttcagggcgttcccttatttcgttcatcctt

SEQ ID NO: 445 - DNA, 59 bp, synthetic construct
  misc_feature 1..59: note = nucleic acid sequence
  source 1..59: mol_type = other DNA
tacgggaggttggtcacgttttctgctgttgtgcgctcttctgccgcttatcacaaatt

SEQ ID NO: 446 - DNA, 51 bp, synthetic construct
  misc_feature 1..51: note = nucleic acid sequence
  source 1..51: mol_type = other DNA
tattagcagttcgcctttctttgccgtcgtttgggcgggttccaggcggtt

SEQ ID NO: 447 - DNA, 48 bp, synthetic construct
  misc_feature 1..48: note = nucleic acid sequence
  source 1..48: mol_type = other DNA
tgtaggaaatttaccgtaagttatgtttaaaaggcctttgtaggtatt

SEQ ID NO: 448 - DNA, 58 bp, synthetic construct
  misc_feature 1..58: note = nucleic acid sequence
  source 1..58: mol_type = other DNA
tctaatacgtagatgtttcgtcaatgttcgccagtgttttatcaggttggataatatt

SEQ ID NO: 449 - DNA, 77 bp, synthetic construct
  misc_feature 1..77: note = nucleic acid sequence
  source 1..77: mol_type = other DNA
tagacctcccaccgtacttgcatatgttacgccgtattggcatggttcggggccgttggtggcctttcagttacctt

SEQ ID NO: 450 - DNA, 39 bp, synthetic construct
  misc_feature 1..39: note = nucleic acid sequence
  source 1..39: mol_type = other DNA
ttggtcacttcctatagtttccgcccatttcgaaatctt

SEQ ID NO: 451 - DNA, 40 bp, synthetic construct
  misc_feature 1..40: note = nucleic acid sequence
  source 1..40: mol_type = other DNA
ttcgccggattgagcggcttgggtggagttcccgaaaatt

SEQ ID NO: 452 - DNA, 39 bp, synthetic construct
  misc_feature 1..39: note = nucleic acid sequence
  source 1..39: mol_type = other DNA
tcggacttgttaagctcccttgcgaaacccgacaggatt

SEQ ID NO: 453 - DNA, 57 bp, synthetic construct
  misc_feature 1..57: note = nucleic acid sequence
  source 1..57: mol_type = other DNA
ttccttgaattacgggcattgagtgatcttccagaattttgtcacgtttgttatctt

SEQ ID NO: 454 - DNA, 68 bp, synthetic construct
  misc_feature 1..68: note = nucleic acid sequence
  source 1..68: mol_type = other DNA
tcacctcggtttcagggtttctagattattgcgatgcattaacgttgtttataattctcttactgttt

SEQ ID NO: 455 - DNA, 51 bp, synthetic construct
  misc_feature 1..51: note = nucleic acid sequence
  source 1..51: mol_type = other DNA
tcatgccgattgcttgccgttggatccgatttacgacatttgttaaatctt

SEQ ID NO: 456 - DNA, 57 bp, synthetic construct
  misc_feature 1..57: note = nucleic acid sequence
  source 1..57: mol_type = other DNA
tcttgtacattaccgcgattaatgaagttttaaatttctggtagcttgtaacaggtt

SEQ ID NO: 457 - DNA, 49 bp, synthetic construct
  misc_feature 1..49: note = nucleic acid sequence
  source 1..49: mol_type = other DNA
tccttccattaccatctcttcacgctgattagcgatgatttatgggctt

SEQ ID NO: 458 - DNA, 62 bp, synthetic construct
  misc_feature 1..62: note = nucleic acid sequence
  source 1..62: mol_type = other DNA
tttttaaaaataaacaaataggggttccgcgttgcggatacttccttgctcttgggtcaagt

SEQ ID NO: 459 - DNA, 59 bp, synthetic construct
  misc_feature 1..59: note = nucleic acid sequence
  source 1..59: mol_type = other DNA
ttttttattaaagaacgtggattggaacaattgcgggcgtttagccagattggcagttt

SEQ ID NO: 460 - DNA, 30 bp, synthetic construct
  misc_feature 1..30: note = nucleic acid sequence
  source 1..30: mol_type = other DNA
tttttgcgaaaaaccgtctattctccaact

SEQ ID NO: 461 - DNA, 66 bp, synthetic construct
  misc_feature 1..66: note = nucleic acid sequence
  source 1..66: mol_type = other DNA
ttccagtctttaagtcattctgagaatagtttttttttttgtatgcggcttatgtatttagttttt

SEQ ID NO: 462 - DNA, 42 bp, synthetic construct
  misc_feature 1..42: note = nucleic acid sequence
  source 1..42: mol_type = other DNA
ttttttatccgcctccattgggggaggggcaaacaacttttt

SEQ ID NO: 463 - DNA, 48 bp, synthetic construct
  misc_feature 1..48: note = nucleic acid sequence
  source 1..48: mol_type = other DNA
ttttttttcgtgaaccatcattgacttaatgtcacattccgccttttt

SEQ ID NO: 464 - DNA, 38 bp, synthetic construct
  misc_feature 1..38: note = nucleic acid sequence
  source 1..38: mol_type = other DNA
tttttcagtggaacgaattgttgtagtttaactagaat

SEQ ID NO: 465 - DNA, 65 bp, synthetic construct
  misc_feature 1..65: note = nucleic acid sequence
  source 1..65: mol_type = other DNA
ttttttttggtcgaggtgccgtaaattatttggtatctgcgctctgttcctatcttttgtcgggt

SEQ ID NO: 466 - DNA, 50 bp, synthetic construct
  misc_feature 1..50: note = nucleic acid sequence
  source 1..50: mol_type = other DNA
tttttcgttcagcccgaccgttgtgtgcacttgttgccgttcgtaattgt

SEQ ID NO: 467 - DNA, 44 bp, synthetic construct
  misc_feature 1..44: note = nucleic acid sequence
  source 1..44: mol_type = other DNA
tttttcctaaagggagcccccttaccaggcgtttttgaagaact

SEQ ID NO: 468 - DNA, 42 bp, synthetic construct
  misc_feature 1..42: note = nucleic acid sequence
  source 1..42: mol_type = other DNA
tttttataactagtcaataatcaatgtcaacttaatgaccct

SEQ ID NO: 469 - DNA, 69 bp, synthetic construct
  misc_feature 1..69: note = nucleic acid sequence
  source 1..69: mol_type = other DNA
tttttccggcgaacgtggcgattcgtaaatactcttgatttgatttagagcttgacggggaaagttttt

SEQ ID NO: 470 - DNA, 33 bp, synthetic construct
  misc_feature 1..33: note = nucleic acid sequence
  source 1..33: mol_type = other DNA
ttttttgatgtactgcttattactattattttt

SEQ ID NO: 471 - DNA, 43 bp, synthetic construct
  misc_feature 1..43: note = nucleic acid sequence
  source 1..43: mol_type = other DNA
tttttatgggcaccaccccggtttccagctcgaccaggttttt

SEQ ID NO: 472 - DNA, 75 bp, synthetic construct
  misc_feature 1..75: note = nucleic acid sequence
  source 1..75: mol_type = other DNA
tttttaagtgtagcggttttacttgaaaggaagggaagattttttttttaagcgaaaggattgagtccacttttt

SEQ ID NO: 473 - DNA, 77 bp, synthetic construct
  misc_feature 1..77: note = nucleic acid sequence
  source 1..77: mol_type = other DNA
tcacttgtggtcggggtagtttctttgctttcccagcattttacatgatcccccttgggcgatggcccactattttt

SEQ ID NO: 474 - DNA, 43 bp, synthetic construct
  misc_feature 1..43: note = nucleic acid sequence
  source 1..43: mol_type = other DNA
tcgtcgccgtttgaacagttaccgctatccacgcccatttttt

SEQ ID NO: 475 - DNA, 64 bp, synthetic construct
  misc_feature 1..64: note = nucleic acid sequence
  source 1..64: mol_type = other DNA
tgaagtcgatttatagacgtttatccggttttttgatcttttctacggggtctgacgctttttt

SEQ ID NO: 476 - DNA, 33 bp, synthetic construct
  misc_feature 1..33: note = nucleic acid sequence
  source 1..33: mol_type = other DNA
ttttttgtgccccaggatttgaacccccttttt

SEQ ID NO: 477 - DNA, 45 bp, synthetic construct
  misc_feature 1..45: note = nucleic acid sequence
  source 1..45: mol_type = other DNA
tttttcccgccgcgctttttggttgcgcgtaaccaccacattttt

SEQ ID NO: 478 - DNA, 36 bp, synthetic construct
  misc_feature 1..36: note = nucleic acid sequence
  source 1..36: mol_type = other DNA
tgtgctcagttagtttgcactaaatcggaacttttt

SEQ ID NO: 479 - DNA, 47 bp, synthetic construct
  misc_feature 1..47: note = nucleic acid sequence
  source 1..47: mol_type = other DNA
tgtagtggtttcagcgatctgtcttttaatcaagttttttggttttt

SEQ ID NO: 480 - DNA, 46 bp, synthetic construct
  misc_feature 1..46: note = nucleic acid sequence
  source 1..46: mol_type = other DNA
tttgtggctttaactcacgttcagaagtggtcctgcaacttttttt

SEQ ID NO: 481 - DNA, 35 bp, synthetic construct
  misc_feature 1..35: note = nucleic acid sequence
  source 1..35: mol_type = other DNA
tttttagatggctggctttgtactccagctttttt

SEQ ID NO: 482 - DNA, 30 bp, synthetic construct
  misc_feature 1..30: note = nucleic acid sequence
  source 1..30: mol_type = other DNA
ttttttcagaagccattgtcaaaggttttt

SEQ ID NO: 483 - DNA, 29 bp, synthetic construct
  misc_feature 1..29: note = nucleic acid sequence
  source 1..29: mol_type = other DNA
ttagagcccttctagggcgctggcttttt

SEQ ID NO: 484 - DNA, 32 bp, synthetic construct
  misc_feature 1..32: note = nucleic acid sequence
  source 1..32: mol_type = other DNA
gaaccgtaccactacgtgaaccatgccgtaaa

SEQ ID NO: 485 - DNA, 54 bp, synthetic construct
  misc_feature 1..54: note = nucleic acid sequence
  source 1..54: mol_type = other DNA
accgtaagttatgtactgcatttaccgtcattgacgtcaatagggggccaggcg

SEQ ID NO: 486 - DNA, 55 bp, synthetic construct
  misc_feature 1..55: note = nucleic acid sequence
  source 1..55: mol_type = other DNA
ggcgttaccaaaaaggttttgttacctaaatgcactaaaagccatagagcccacc

SEQ ID NO: 487 - DNA, 54 bp, synthetic construct
  misc_feature 1..54: note = nucleic acid sequence
  source 1..54: mol_type = other DNA
gcgtacttcataaggtcatgtactttggtgcctgcttaatgactcctattattg

SEQ ID NO: 488 - DNA, 46 bp, synthetic construct
  misc_feature 1..46: note = nucleic acid sequence
  source 1..46: mol_type = other DNA
caagtagcgaaaacgggcggggattactattaataactttccatag

SEQ ID NO: 489 - DNA, 54 bp, synthetic construct
  misc_feature 1..54: note = nucleic acid sequence
  source 1..54: mol_type = other DNA
tacgtagatgtactgcatggggtgatatgagtgggagggtgttgaagtgcaccc

SEQ ID NO: 490 - DNA, 40 bp, synthetic construct
  misc_feature 1..40: note = nucleic acid sequence
  source 1..40: mol_type = other DNA
aatagcgagagattattatgggaatcaacgcgtatatcaa

SEQ ID NO: 491 - DNA, 54 bp, synthetic construct
  misc_feature 1..54: note = nucleic acid sequence
  source 1..54: mol_type = other DNA
accgcatcaccatggtcaaaccgaaaaatgacaatgatacgcaaaatttcacca

SEQ ID NO: 492 - DNA, 39 bp, synthetic construct
  misc_feature 1..39: note = nucleic acid sequence
  source 1..39: mol_type = other DNA
tgggttctctagttagagtgagtcagatttattggtatg

SEQ ID NO: 493 - DNA, 47 bp, synthetic construct
  misc_feature 1..47: note = nucleic acid sequence
  source 1..47: mol_type = other DNA
ctctgatggatatctgcagaattggggcggatagttgcctcagtgag

SEQ ID NO: 494 - DNA, 39 bp, synthetic construct
  misc_feature 1..39: note = nucleic acid sequence
  source 1..39: mol_type = other DNA
ccagcacattatccgcgttaataatcattgggcactgca

SEQ ID NO: 495 - DNA, 38 bp, synthetic construct
  misc_feature 1..38: note = nucleic acid sequence
  source 1..38: mol_type = other DNA
ctggcggctcgcccttgctcactgggccagccgatcgt

SEQ ID NO: 496 - DNA, 44 bp, synthetic construct
  misc_feature 1..44: note = nucleic acid sequence
  source 1..44: mol_type = other DNA
gcttgggtctccctatccagagaagtgctgagttttaaagtgcc

SEQ ID NO: 497 - DNA, 30 bp, synthetic construct
  misc_feature 1..30: note = nucleic acid sequence
  source 1..30: mol_type = other DNA
ttgtggccgtttacgtgtggcatatcaagg

SEQ ID NO: 498 - DNA, 53 bp, synthetic construct
  misc_feature 1..53: note = nucleic acid sequence
  source 1..53: mol_type = other DNA
gcagcttgccggtggtcccggtgtgccattgagcgcagcccactctactcata

SEQ ID NO: 499 - DNA, 38 bp, synthetic construct
  misc_feature 1..38: note = nucleic acid sequence
  source 1..38: mol_type = other DNA
gcagatggtgcaaaaggttcacctgcttgtcggccatg

SEQ ID NO: 500 - DNA, 39 bp, synthetic construct
  misc_feature 1..39: note = nucleic acid sequence
  source 1..39: mol_type = other DNA
aacttcagtggcggacttgaagaagtcgtgcctcgatgc

SEQ ID NO: 501 - DNA, 53 bp, synthetic construct
  misc_feature 1..53: note = nucleic acid sequence
  source 1..53: mol_type = other DNA
ggtcagcttgccgtagcgccgtctcgtcgttcagcaatcttttacaagggaat

SEQ ID NO: 502 - DNA, 55 bp, synthetic construct
  misc_feature 1..55: note = nucleic acid sequence
  source 1..55: mol_type = other DNA
atggtgcgctcctggacgtagccaacttcaccgagttacggtgagtaccggcgtc

SEQ ID NO: 503 - DNA, 54 bp, synthetic construct
  misc_feature 1..54: note = nucleic acid sequence
  source 1..54: mol_type = other DNA
tgccgtcctgtcagaatatggcaaaaacgttggtcaaggtcctcattttattag

SEQ ID NO: 504 - DNA, 31 bp, synthetic construct
  misc_feature 1..31: note = nucleic acid sequence
  source 1..31: mol_type = other DNA
tccttgaatgttgtagttgtactgggcggac

SEQ ID NO: 505 - DNA, 30 bp, synthetic construct
  misc_feature 1..30: note = nucleic acid sequence
  source 1..30: mol_type = other DNA
ctcggcggatcttgaagttcacgtgttctg

SEQ ID NO: 506 - DNA, 31 bp, synthetic construct
  misc_feature 1..31: note = nucleic acid sequence
  source 1..31: mol_type = other DNA
gttgtggcgtcgatgcccttcagtgcttcat

SEQ ID NO: 507 - DNA, 31 bp, synthetic construct
  misc_feature 1..31: note = nucleic acid sequence
  source 1..31: mol_type = other DNA
cgttcttcagggtgtcgccctcgttcgggca

SEQ ID NO: 508 - DNA, 39 bp, synthetic construct
  misc_feature 1..39: note = nucleic acid sequence
  source 1..39: mol_type = other DNA
cttgatgctgtgactatgatccctgtcacgccagctcga

SEQ ID NO: 509 - DNA, 32 bp, synthetic construct
  misc_feature 1..32: note = nucleic acid sequence
  source 1..32: mol_type = other DNA
gggcagcatcacgaactccagcagggcaaaca

SEQ ID NO: 510 - DNA, 37 bp, synthetic construct
  misc_feature 1..37: note = nucleic acid sequence
  source 1..37: mol_type = other DNA
cttctcgttggggtcccttccagcttcggggcgaagc

SEQ ID NO: 511 - DNA, 55 bp, synthetic construct
  misc_feature 1..55: note = nucleic acid sequence
  source 1..55: mol_type = other DNA
tgatcgcgtgggtgctcaggtagtggttgtcatatagacttactgtcagctcctt

SEQ ID NO: 512 - DNA, 40 bp, synthetic construct
  misc_feature 1..40: note = nucleic acid sequence
  source 1..40: mol_type = other DNA
tcgtccatgccgagagcacagtcgaatacgggttcagcat

SEQ ID NO: 513 - DNA, 45 bp, synthetic construct
  misc_feature 1..45: note = nucleic acid sequence
  source 1..45: mol_type = other DNA
aggctgatgtcctgccccacccacattccaagggcgatccccgaa

SEQ ID NO: 514 - DNA, 39 bp, synthetic construct
  misc_feature 1..39: note = nucleic acid sequence
  source 1..39: mol_type = other DNA
atgacacctactcagcgtaaccactcttcctaaaataaa

SEQ ID NO: 515 - DNA, 38 bp, synthetic construct
  misc_feature 1..38: note = nucleic acid sequence
  source 1..38: mol_type = other DNA
agaatagactggcaactagaaggtgatccctgcttttc

SEQ ID NO: 516 - DNA, 38 bp, synthetic construct
  misc_feature 1..38: note = nucleic acid sequence
  source 1..38: mol_type = other DNA
caccccccaactgatcataataccatcgtggccatgtt

SEQ ID NO: 517 - DNA, 32 bp, synthetic construct
  misc_feature 1..32: note = nucleic acid sequence
  source 1..32: mol_type = other DNA
ccccttgctcagcgagctctagcagattactt

SEQ ID NO: 518 - DNA, 38 bp, synthetic construct
  misc_feature 1..38: note = nucleic acid sequence
  source 1..38: mol_type = other DNA
gggcgctgatcagggttattctatatttcgtaattgtt

SEQ ID NO: 519 - DNA, 30 bp, synthetic construct
  misc_feature 1..30: note = nucleic acid sequence
  source 1..30: mol_type = other DNA
ccacaccgcttgacggggaaagggactcca

SEQ ID NO: 520 - DNA, 30 bp, synthetic construct
  misc_feature 1..30: note = nucleic acid sequence
  source 1..30: mol_type = other DNA
gcctcagatcggaaccctaaaggtatcagg

SEQ ID NO: 521 - DNA, 38 bp, synthetic construct
  misc_feature 1..38: note = nucleic acid sequence
  source 1..38: mol_type = other DNA
gaaaggaagggaagatttggaacgatagggtctccata

SEQ ID NO: 522 - DNA, 55 bp, synthetic construct
  misc_feature 1..55: note = nucleic acid sequence
  source 1..55: mol_type = other DNA
cactattaaagaacgtccggcgaatatttagattttcaaccgtcgtgctgcaact

SEQ ID NO: 523 - DNA, 40 bp, synthetic construct
  misc_feature 1..40: note = nucleic acid sequence
  source 1..40: mol_type = other DNA
agggcgaaaaaccgtcgagccccccgcacattcacggaaa

SEQ ID NO: 524 - DNA, 53 bp, synthetic construct
  misc_feature 1..53: note = nucleic acid sequence
  source 1..53: mol_type = other DNA
tgagtgtcaagaagactcagcgatcctttggaaagtcccgttgattgggcata

SEQ ID NO: 525 - DNA, 45 bp, synthetic construct
  misc_feature 1..45: note = nucleic acid sequence
  source 1..45: mol_type = other DNA
tataaatctgacgctgttaccaaaaaacaacccatttgcgtcaat

SEQ ID NO: 526 - DNA, 30 bp, synthetic construct
  misc_feature 1..30: note = nucleic acid sequence
  source 1..30: mol_type = other DNA
aaatccctgtaattggtcgttgggcggtca

SEQ ID NO: 527 - DNA, 46 bp, synthetic construct
  misc_feature 1..46: note = nucleic acid sequence
  source 1..46: mol_type = other DNA
aatcggcaacgtcaagctccgcccccctgacgagcatcatgacccc

SEQ ID NO: 528 - DNA, 63 bp, synthetic construct
  misc_feature 1..63: note = nucleic acid sequence
  source 1..63: mol_type = other DNA
taaccaatagggattttaaagtatgagactttatatagacctcccaccgagctcgaagggccg

SEQ ID NO: 529 - DNA, 38 bp, synthetic construct
  misc_feature 1..38: note = nucleic acid sequence
  source 1..38: mol_type = other DNA
tcatttttaatcaatgcatacgtcattattgtgccaag

SEQ ID NO: 530 - DNA, 46 bp, synthetic construct
  misc_feature 1..46: note = nucleic acid sequence
  source 1..46: mol_type = other DNA
aaatcagcgcgatggcaaaaggccgcgttgctggcgtttagtcaat

SEQ ID NO: 531 - DNA, 54 bp, synthetic construct
  misc_feature 1..54: note = nucleic acid sequence
  source 1..54: mol_type = other DNA
atacatattagaccgaaagagtccgacgctcaagtcagaggtgcagacgcggaa

SEQ ID NO: 532 - DNA, 45 bp, synthetic construct
  misc_feature 1..45: note = nucleic acid sequence
  source 1..45: mol_type = other DNA
tgttgagatgcaattaaggcacgggggagggaccatgtaattctc

SEQ ID NO: 533 - DNA, 52 bp, synthetic construct
  misc_feature 1..52: note = nucleic acid sequence
  source 1..52: mol_type = other DNA
agtgctcgtttgcgccggtcctggcacgggtggtcggggtagcggctgaagc

SEQ ID NO: 534 - DNA, 56 bp, synthetic construct
  misc_feature 1..56: note = nucleic acid sequence
  source 1..56: mol_type = other DNA
actttaaacgatgtaaaagtggtctagataacgcctaccgactcccattgacgtca

SEQ ID NO: 535 - DNA, 31 bp, synthetic construct
  misc_feature 1..31: note = nucleic acid sequence
  source 1..31: mol_type = other DNA
aagcggttatgccatatagcagaacagatgg

SEQ ID NO: 536 - DNA, 54 bp, synthetic construct
  misc_feature 1..54: note = nucleic acid sequence
  source 1..54: mol_type = other DNA
aagctagggccgcaggtcggtcagggtggtcacgagggcatctcgagttcgcca

SEQ ID NO: 537 - DNA, 61 bp, synthetic construct
  misc_feature 1..61: note = nucleic acid sequence
  source 1..61: mol_type = other DNA
aacgttgtaacagctcccgttactagtggatccgtacactacgatacaaacttgcaaatag

SEQ ID NO: 538 - DNA, 54 bp, synthetic construct
  misc_feature 1..54: note = nucleic acid sequence
  source 1..54: mol_type = other DNA
ctacaggcgcgccacccgtaagaggcggcgggcacggggccgtcgccgatgggg

SEQ ID NO: 539 - DNA, 30 bp, synthetic construct
  misc_feature 1..30: note = nucleic acid sequence
  source 1..30: mol_type = other DNA
ctccatccttaccgcaagcatttgcaagtg

SEQ ID NO: 540 - DNA, 39 bp, synthetic construct
  misc_feature 1..39: note = nucleic acid sequence
  source 1..39: mol_type = other DNA
aaaccagctggccccgctctgctggaaatccccgtgagt

SEQ ID NO: 541 - DNA, 39 bp, synthetic construct
  misc_feature 1..39: note = nucleic acid sequence
  source 1..39: mol_type = other DNA
cttaccatccagccgggtaccaaccaggatgggcaccac

SEQ ID NO: 542 - DNA, 55 bp, synthetic construct
  misc_feature 1..55: note = nucleic acid sequence
  source 1..55: mol_type = other DNA
gtctgacacagtggaagaaagtccggcatatgatacacttgatgtacacgtcaat

SEQ ID NO: 543 - DNA, 46 bp, synthetic construct
  misc_feature 1..46: note = nucleic acid sequence
  source 1..46: mol_type = other DNA
aatcaatctggtcattgactaatgggcagtttaccgtaaatactcc

SEQ ID NO: 544 - DNA, 39 bp, synthetic construct
  misc_feature 1..39: note = nucleic acid sequence
  source 1..39: mol_type = other DNA
tcttttcggccattttatgggctatgaactaacaaaaat

SEQ ID NO: 545 - DNA, 63 bp, synthetic construct
  misc_feature 1..63: note = nucleic acid sequence
  source 1..63: mol_type = other DNA
tacggggtcaaaagaattgaatgcgtggcgatagcggtcacgctgcgacaatgcgatccagtt

SEQ ID NO: 546 - DNA, 47 bp, synthetic construct
  misc_feature 1..47: note = nucleic acid sequence
  source 1..47: mol_type = other DNA
tcacgttaaggccgagggttccggatttagacgccgcgcttaatgtc

SEQ ID NO: 547 - DNA, 55 bp, synthetic construct
  misc_feature 1..55: note = nucleic acid sequence
  source 1..55: mol_type = other DNA
ctcttgcctcaaccagtacagcctggtagtggtcggcgagctgcacgctgttttt

SEQ ID NO: 548 - DNA, 52 bp, synthetic construct
  misc_feature 1..52: note = nucleic acid sequence
  source 1..52: mol_type = other DNA
tttttccagcaaaaggccagtgagtgacgttaaatatcttcacctagttttt

SEQ ID NO: 549 - DNA, 51 bp, synthetic construct
  misc_feature 1..51: note = nucleic acid sequence
  source 1..51: mol_type = other DNA
tttttggcgtttccccctgggactataatgctacagtgttccagaagcgaa

SEQ ID NO: 550 - DNA, 27 bp, synthetic construct
  misc_feature 1..27: note = nucleic acid sequence
  source 1..27: mol_type = other DNA
ttttttggaaagtccctattacccatt

SEQ ID NO: 551 - DNA, 53 bp, synthetic construct
  misc_feature 1..53: note = nucleic acid sequence
  source 1..53: mol_type = other DNA
tttttctctcctgttccgaccaagctcccaggatctagttcttgaagtttttt

SEQ ID NO: 552 - DNA, 42 bp, synthetic construct
  misc_feature 1..42: note = nucleic acid sequence
  source 1..42: mol_type = other DNA
tttttctgtccgcctttctctcaagcagcagattacgttttt

SEQ ID NO: 553 - DNA, 59 bp, synthetic construct
  misc_feature 1..59: note = nucleic acid sequence
  source 1..59: mol_type = other DNA
tttttcagtaagcaggcccattgatgtttttttttttactgccaaagacgtcaattttt

SEQ ID NO: 554 - DNA, 42 bp, synthetic construct
  misc_feature 1..42: note = nucleic acid sequence
  source 1..42: mol_type = other DNA
tttttcgctttctcataggccccaccgctggtagcggttttt

SEQ ID NO: 555 - DNA, 31 bp, synthetic construct
  misc_feature 1..31: note = nucleic acid sequence
  source 1..31: mol_type = other DNA
tttttcacgctgaactttcgataagcttttt

SEQ ID NO: 556 - DNA, 41 bp, synthetic construct
  misc_feature 1..41: note = nucleic acid sequence
  source 1..41: mol_type = other DNA
tttttcagttcggtgtagaaagagttggtagctcttttttt

SEQ ID NO: 557 - DNA, 33 bp, synthetic construct
  misc_feature 1..33: note = nucleic acid sequence
  source 1..33: mol_type = other DNA
ttttttccttgaagaagccctcgccggattttt

SEQ ID NO: 558 - DNA, 62 bp, synthetic construct
  misc_feature 1..62: note = nucleic acid sequence
  source 1..62: mol_type = other DNA
ttttttgggctgtgtgcacgacccaggatgtactgcacgccgtagttcgctccaagcttttt

SEQ ID NO: 559 - DNA, 32 bp, synthetic construct
  misc_feature 1..32: note = nucleic acid sequence
  source 1..32: mol_type = other DNA
tttttccgtcctcgatgtgagaatagtttttt

SEQ ID NO: 560 - DNA, 47 bp, synthetic construct
  misc_feature 1..47: note = nucleic acid sequence
  source 1..47: mol_type = other DNA
tttttcgaccgctgcgccttatctttgctcaccagcttgctcatggt

SEQ ID NO: 561 - DNA, 41 bp, synthetic construct
  misc_feature 1..41: note = nucleic acid sequence
  source 1..41: mol_type = other DNA
tttttagaatagggccctctatttaggtgacactatttttt

SEQ ID NO: 562 - DNA, 39 bp, synthetic construct
  misc_feature 1..39: note = nucleic acid sequence
  source 1..39: mol_type = other DNA
tttttcggtaagacacgacttgggagtggcacggtaact

SEQ ID NO: 563 - DNA, 41 bp, synthetic construct
  misc_feature 1..41: note = nucleic acid sequence
  source 1..41: mol_type = other DNA
aatcctcgcgtttctccgagttggcttcattcagctttttt

SEQ ID NO: 564 - DNA, 41 bp, synthetic construct
  misc_feature 1..41: note = nucleic acid sequence
  source 1..41: mol_type = other DNA
tttttctgctattgtcttcccgcatccccagcatgcttttt

SEQ ID NO: 565 - DNA, 40 bp, synthetic construct
  misc_feature 1..40: note = nucleic acid sequence
  source 1..40: mol_type = other DNA
tttttagccactggtaacaggagcgggcgctagaaaggac

SEQ ID NO: 566 - DNA, 40 bp, synthetic construct
  misc_feature 1..40: note = nucleic acid sequence
  source 1..40: mol_type = other DNA
tttttttttggggtcgaggtcaccctaatcaagttttttt

SEQ ID NO: 567 - DNA, 29 bp, synthetic construct
  misc_feature 1..29: note = nucleic acid sequence
  source 1..29: mol_type = other DNA
ttttttatgtaggcggagataccattttt

SEQ ID NO: 568 - DNA, 41 bp, synthetic construct
  misc_feature 1..41: note = nucleic acid sequence
  source 1..41: mol_type = other DNA
tttttggtggcctaactaaggattagcagagcgaggttttt

SEQ ID NO: 569 - DNA, 65 bp, synthetic construct
  misc_feature 1..65: note = nucleic acid sequence
  source 1..65: mol_type = other DNA
cgggtctcatgagcgggcacctattcctttgaatgccaggcgggcccgcttaccggatacttttt

SEQ ID NO: 570 - DNA, 34 bp, synthetic construct
  misc_feature 1..34: note = nucleic acid sequence
  source 1..34: mol_type = other DNA
tgtaagcgcaaaatgcccgcgagacccacttttt

SEQ ID NO: 571 - DNA, 60 bp, synthetic construct
  misc_feature 1..60: note = nucleic acid sequence
  source 1..60: mol_type = other DNA
tttttaaacaggaaggttaatattttttttttttttgttaaaattcggcaaaaggttttt

SEQ ID NO: 572 - DNA, 41 bp, synthetic construct
  misc_feature 1..41: note = nucleic acid sequence
  source 1..41: mol_type = other DNA
tttttagtatttggtatcagtatcgccactggcagcttttt

SEQ ID NO: 573 - DNA, 65 bp, synthetic construct
  misc_feature 1..65: note = nucleic acid sequence
  source 1..65: mol_type = other DNA
tgcaactctcaaggatcagtctatttcatccagttgttacgacatcttcgggaagcgtggttttt

SEQ ID NO: 574 - DNA, 31 bp, synthetic construct
  misc_feature 1..31: note = nucleic acid sequence
  source 1..31: mol_type = other DNA
tttttgtatgcggcgagggtgagcaattttt

SEQ ID NO: 575 - DNA, 41 bp, synthetic construct
  misc_feature 1..41: note = nucleic acid sequence
  source 1..41: mol_type = other DNA
tttttgttaccttcggaaatcgtcttgagtccaaccttttt

SEQ ID NO: 576 - DNA, 31 bp, synthetic construct
  misc_feature 1..31: note = nucleic acid sequence
  source 1..31: mol_type = other DNA
tgttatcatgcaccccccgttcagccttttt

SEQ ID NO: 577 - DNA, 42 bp, synthetic construct
  misc_feature 1..42: note = nucleic acid sequence
  source 1..42: mol_type = other DNA
agtcattcttgtggcgcgggtcttgtagttgccgtcgttttt

SEQ ID NO: 578 - DNA, 48 bp, synthetic construct
  misc_feature 1..48: note = nucleic acid sequence
  source 1..48: mol_type = other DNA
gtaagttagtaagtagcggccgccagtgacgctgtaggtatctttttt

SEQ ID NO: 579 - DNA, 26 bp, synthetic construct
  misc_feature 1..26: note = nucleic acid sequence
  source 1..26: mol_type = other DNA
tttttccggttcccaacgcgccctcg

SEQ ID NO: 580 - DNA, 41 bp, synthetic construct
  misc_feature 1..41: note = nucleic acid sequence
  source 1..41: mol_type = other DNA
tttttgatccggcaaacaaagggtctgctgaagccattttt

SEQ ID NO: 581 - DNA, 25 bp, synthetic construct
  misc_feature 1..25: note = nucleic acid sequence
  source 1..25: mol_type = other DNA
tttttgctcaccggctccgtattaa

SEQ ID NO: 582 - DNA, 40 bp, synthetic construct
  misc_feature 1..40: note = nucleic acid sequence
  source 1..40: mol_type = other DNA
ttttttggtttttttgtttggtccactagaagaacttttt

SEQ ID NO: 583 - DNA, 26 bp, synthetic construct
  misc_feature 1..26: note = nucleic acid sequence
  source 1..26: mol_type = other DNA
tttttatccttttaaattctatccac

SEQ ID NO: 584 - DNA, 28 bp, synthetic construct
  misc_feature 1..28: note = nucleic acid sequence
  source 1..28: mol_type = other DNA
tttttcgcagaaaaaatcgtgcgttttt

SEQ ID NO: 585 - DNA, 32 bp, synthetic construct
  misc_feature 1..32: note = nucleic acid sequence
  source 1..32: mol_type = other DNA
tgcacgaagtcctccgatcgttgttaaaattc

SEQ ID NO: 586 - DNA, 31 bp, synthetic construct
  misc_feature 1..31: note = nucleic acid sequence
  source 1..31: mol_type = other DNA
cgttcgctccaagctgggctgtggtactgcc

SEQ ID NO: 587 - DNA, 32 bp, synthetic construct
  misc_feature 1..32: note = nucleic acid sequence
  source 1..32: mol_type = other DNA
gtgtaggtcgcagtgttatcactcgccaccta

SEQ ID NO: 588 - DNA, 31 bp, synthetic construct
  misc_feature 1..31: note = nucleic acid sequence
  source 1..31: mol_type = other DNA
cacgctgtaggtatctcagttcgctccaccc

SEQ ID NO: 589 - DNA, 31 bp, synthetic construct
  misc_feature 1..31: note = nucleic acid sequence
  source 1..31: mol_type = other DNA
tcatagctctgcataattctctttaggggtt

SEQ ID NO: 590 - DNA, 31 bp, synthetic construct
  misc_feature 1..31: note = nucleic acid sequence
  source 1..31: mol_type = other DNA
ccttcgggaagcgtggcgctttcattggcgt

SEQ ID NO: 591 - DNA, 30 bp, synthetic construct
  misc_feature 1..30: note = nucleic acid sequence
  source 1..30: mol_type = other DNA
ctttctctaagatgcttttctgatatttga

SEQ ID NO: 592 - DNA, 31 bp, synthetic construct
  misc_feature 1..31: note = nucleic acid sequence
  source 1..31: mol_type = other DNA
gccgcttaccggatacctgtccgcttgacgt

SEQ ID NO: 593 - DNA, 30 bp, synthetic construct
  misc_feature 1..30: note = nucleic acid sequence
  source 1..30: mol_type = other DNA
cgaccctaaccaagtcattctgttatcagg

SEQ ID NO: 594 - DNA, 30 bp, synthetic construct
  misc_feature 1..30: note = nucleic acid sequence
  source 1..30: mol_type = other DNA
ctccctcgtgcgctctcctgttctcagcca

SEQ ID NO: 595 - DNA, 30 bp, synthetic construct
  misc_feature 1..30: note = nucleic acid sequence
  source 1..30: mol_type = other DNA
cctggaagcgaccgagttgctctactcttc

SEQ ID NO: 596 - DNA, 31 bp, synthetic construct
  misc_feature 1..31: note = nucleic acid sequence
  source 1..31: mol_type = other DNA
tataaagataccaggcgtttccctgtaacgc

SEQ ID NO: 597 - DNA, 31 bp, synthetic construct
  misc_feature 1..31: note = nucleic acid sequence
  source 1..31: mol_type = other DNA
gacaggaccgggataataccgcgctaagggc

SEQ ID NO: 598 - DNA, 31 bp, synthetic construct
  misc_feature 1..31: note = nucleic acid sequence
  source 1..31: mol_type = other DNA
tcaagtcagaggtggcgaaacccactaatga

SEQ ID NO: 599 - DNA, 32 bp, synthetic construct
  misc_feature 1..32: note = nucleic acid sequence
  source 1..32: mol_type = other DNA
atcgacgctaaaagtgctcatcatacaggaag

SEQ ID NO: 600 - DNA, 31 bp, synthetic construct
  misc_feature 1..31: note = nucleic acid sequence
  source 1..31: mol_type = other DNA
cccccctgacgagcatcacaaaaaactagtc

SEQ ID NO: 601 - DNA, 24 bp, synthetic construct
  misc_feature 1..24: note = nucleic acid sequence
  source 1..24: mol_type = other DNA
aggctccgggggcgaaaactctca

SEQ ID NO: 602 - DNA, 31 bp, synthetic construct
  misc_feature 1..31: note = nucleic acid sequence
  source 1..31: mol_type = other DNA
ccgcgttgctggcgtttttccattcaatgag

SEQ ID NO: 603 - DNA, 62 bp, synthetic construct
  misc_feature 1..62: note = nucleic acid sequence
  source 1..62: mol_type = other DNA
tcattgacgtcaatagtaggtgcagatgaacttcagggtcagcttgggcgggcccgcgcaga

SEQ ID NO: 604 - DNA, 30 bp, synthetic construct
  misc_feature 1..30: note = nucleic acid sequence
  source 1..30: mol_type = other DNA
ccgtaggtacgagggtgggccaggcattta

SEQ ID NO: 605 - DNA, 47 bp, synthetic construct
  misc_feature 1..47: note = nucleic acid sequence
  source 1..47: mol_type = other DNA
ggcatcgccctcgccctcgccggcccataagtttgatctatggcttc

SEQ ID NO: 606 - DNA, 30 bp, synthetic construct
  misc_feature 1..30: note = nucleic acid sequence
  source 1..30: mol_type = other DNA
acacgctggaagcactgcacgccctagatt

SEQ ID NO: 607 - DNA, 30 bp, synthetic construct
  misc_feature 1..30: note = nucleic acid sequence
  source 1..30: mol_type = other DNA
aacttgtggccgtttacgtcgccatacgta

SEQ ID NO: 608 - DNA, 31 bp, synthetic construct
  misc_feature 1..31: note = nucleic acid sequence
  source 1..31: mol_type = other DNA
gtccagctcgtgctgcttcatgtagagtgat

SEQ ID NO: 609 - DNA, 45 bp, synthetic construct
  misc_feature 1..45: note = nucleic acid sequence
  source 1..45: mol_type = other DNA
cgaccaggatgggcaccaccccgaaccgcatcatgagatagtttg

SEQ ID NO: 610 - DNA, 31 bp, synthetic construct
  misc_feature 1..31: note = nucleic acid sequence
  source 1..31: mol_type = other DNA
gtgaacagtagccttcgggcatggcaggacc

SEQ ID NO: 611 - DNA, 39 bp, synthetic construct
  misc_feature 1..39: note = nucleic acid sequence
  source 1..39: mol_type = other DNA
ctcctcgcccttgctcaccatctccgctatcgatccttt

SEQ ID NO: 612 - DNA, 31 bp, synthetic construct
  misc_feature 1..31: note = nucleic acid sequence
  source 1..31: mol_type = other DNA
cgagcgggtccttgaagaagatggtctttgc

SEQ ID NO: 613 - DNA, 39 bp, synthetic construct
  misc_feature 1..39: note = nucleic acid sequence
  source 1..39: mol_type = other DNA
ccgccagtgtgatggatatctgcaggtggagatcaatct

SEQ ID NO: 614 - DNA, 31 bp, synthetic construct
  misc_feature 1..31: note = nucleic acid sequence
  source 1..31: mol_type = other DNA
gaattcctcacctcggcgcgggttagtggtt

SEQ ID NO: 615 - DNA, 38 bp, synthetic construct
  misc_feature 1..38: note = nucleic acid sequence
  source 1..38: mol_type = other DNA
agcacactggcggccgttactagtgccaaaactgacag

SEQ ID NO: 616 - DNA, 32 bp, synthetic construct
  misc_feature 1..32: note = nucleic acid sequence
  source 1..32: mol_type = other DNA
tggatccgatgcggttcaccagggcgccgatg

SEQ ID NO: 617 - DNA, 39 bp, synthetic construct
  misc_feature 1..39: note = nucleic acid sequence
  source 1..39: mol_type = other DNA
agctcggtaccaagcttgggtctacgacattcacctatc

SEQ ID NO: 618 - DNA, 30 bp, synthetic construct
  misc_feature 1..30: note = nucleic acid sequence
  source 1..30: mol_type = other DNA
ccctatagtcctccttgaagtcgggcgagc

SEQ ID NO: 619 - DNA, 39 bp, synthetic construct
  misc_feature 1..39: note = nucleic acid sequence
  source 1..39: mol_type = other DNA
tgagtcgtattaatttcgataagcgcccattatccatag

SEQ ID NO: 620 - DNA, 30 bp, synthetic construct
  misc_feature 1..30: note = nucleic acid sequence
  source 1..30: mol_type = other DNA
ccagtaaggtactccagcttgtgtggcgga

SEQ ID NO: 621 - DNA, 38 bp, synthetic construct
  misc_feature 1..38: note = nucleic acid sequence
  source 1..38: mol_type = other DNA
gtaggtcaaagatccgtcatgtaagtttaccgtaaata

SEQ ID NO: 622 - DNA, 40 bp, synthetic construct
  misc_feature 1..40: note = nucleic acid sequence
  source 1..40: mol_type = other DNA
ggtcggggacgctcaggatgtacttcaatggaaagtccct

SEQ ID NO: 623 - DNA, 40 bp, synthetic construct
  misc_feature 1..40: note = nucleic acid sequence
  source 1..40: mol_type = other DNA
gcggacttgattttggtcaccatgggaacatacgtcatta

SEQ ID NO: 624 - DNA, 38 bp, synthetic construct
  misc_feature 1..38: note = nucleic acid sequence
  source 1..38: mol_type = other DNA
gtgcgctttcacctacacgcccgggggtcgttgggcgg

SEQ ID NO: 625 - DNA, 37 bp, synthetic construct
  misc_feature 1..37: note = nucleic acid sequence
  source 1..37: mol_type = other DNA
cttgtaggttttaaacttggaaatttaccgtaagtta

SEQ ID NO: 626 - DNA, 39 bp, synthetic construct
  misc_feature 1..39: note = nucleic acid sequence
  source 1..39: mol_type = other DNA
tgtcgcccaacttggtcaaactccatatatgggctatga

SEQ ID NO: 627 - DNA, 38 bp, synthetic construct
  misc_feature 1..38: note = nucleic acid sequence
  source 1..38: mol_type = other DNA
atgcccttagtgaggttggaaagttgattactattaat

SEQ ID NO: 628 - DNA, 38 bp, synthetic construct
  misc_feature 1..38: note = nucleic acid sequence
  source 1..38: mol_type = other DNA
ccccaggattcgttctgcgtcaaatgtcaacgcgtata

SEQ ID NO: 629 - DNA, 32 bp, synthetic construct
  misc_feature 1..32: note = nucleic acid sequence
  source 1..32: mol_type = other DNA
ggctggcaactagaagcaataggcgttacatg

SEQ ID NO: 630 - DNA, 40 bp, synthetic construct
  misc_feature 1..40: note = nucleic acid sequence
  source 1..40: mol_type = other DNA
ggaaggcacgggggagaatcaaaaattcagctaagttggc

SEQ ID NO: 631 - DNA, 39 bp, synthetic construct
  misc_feature 1..39: note = nucleic acid sequence
  source 1..39: mol_type = other DNA
gacagtgggagtggctgttgttctggtgtcatggcagca

SEQ ID NO: 632 - DNA, 38 bp, synthetic construct
  misc_feature 1..38: note = nucleic acid sequence
  source 1..38: mol_type = other DNA
gcgatgcaatttcctttaaagacgcaacgtgccatccg

SEQ ID NO: 633 - DNA, 37 bp, synthetic construct
  misc_feature 1..37: note = nucleic acid sequence
  source 1..37: mol_type = other DNA
cccagaatagaatgagaaaaacagagtaagagtactc

SEQ ID NO: 634 - DNA, 38 bp, synthetic construct
  misc_feature 1..38: note = nucleic acid sequence
  source 1..38: mol_type = other DNA
ctcccccttgctgtctacgtgaacatccaggtatgcgg

SEQ ID NO: 635 - DNA, 39 bp, synthetic construct
  misc_feature 1..39: note = nucleic acid sequence
  source 1..39: mol_type = other DNA
ccccagcatgcctgctggggtcgagcagaagtgtcaata

SEQ ID NO: 636 - DNA, 39 bp, synthetic construct
  misc_feature 1..39: note = nucleic acid sequence
  source 1..39: mol_type = other DNA
tccgcctcagaagccaaaccctaagcaataaaagaactt

SEQ ID NO: 637 - DNA, 40 bp, synthetic construct
  misc_feature 1..40: note = nucleic acid sequence
  source 1..40: mol_type = other DNA
accaccacacccgccggacggggaagacccaccgttcttc

SEQ ID NO: 638 - DNA, 39 bp, synthetic construct
  misc_feature 1..39: note = nucleic acid sequence
  source 1..39: mol_type = other DNA
ctggcaagtgtagcgggaagggacatctggctaccgctg

SEQ ID NO: 639 - DNA, 39 bp, synthetic construct
  misc_feature 1..39: note = nucleic acid sequence
  source 1..39: mol_type = other DNA
gcaaaatcccttatagggcaaacatctcaaggggtggtc

SEQ ID NO: 640 - DNA, 37 bp, synthetic construct
  misc_feature 1..37: note = nucleic acid sequence
  source 1..37: mol_type = other DNA
gaatagaaattgtaagcgttaatattttgtcagaagt

SEQ ID NO: 641 - DNA, 39 bp, synthetic construct
  misc_feature 1..39: note = nucleic acid sequence
  source 1..39: mol_type = other DNA
ccgagatagggttgagaccttccagggtctgtagcggct

SEQ ID NO: 642 - DNA, 39 bp, synthetic construct
  misc_feature 1..39: note = nucleic acid sequence
  source 1..39: mol_type = other DNA
gaacaagagtccactacattttatgttaagggaagaagt

SEQ ID NO: 643 - DNA, 31 bp, synthetic construct
  misc_feature 1..31: note = nucleic acid sequence
  source 1..31: mol_type = other DNA
acgtggacatgtatttagaaaaataaacaaa

SEQ ID NO: 644 - DNA, 40 bp, synthetic construct
  misc_feature 1..40: note = nucleic acid sequence
  source 1..40: mol_type = other DNA
tccaacgtcaaagggccacctactaaaggatccctggacg

SEQ ID NO: 645 - DNA, 39 bp, synthetic construct
  misc_feature 1..39: note = nucleic acid sequence
  source 1..39: mol_type = other DNA
agggcgatggcccacctgccccaaaaatgaattgccgtc

SEQ ID NO: 646 - DNA, 37 bp, synthetic construct
  misc_feature 1..37: note = nucleic acid sequence
  source 1..37: mol_type = other DNA
ctaatcaagttttttattgtcttatgagtatcgaact

SEQ ID NO: 647 - DNA, 37 bp, synthetic construct
  misc_feature 1..37: note = nucleic acid sequence
  source 1..37: mol_type = other DNA
aaagcactaaatcggtagagccgcttaatccagctcg

SEQ ID NO: 648 - DNA, 39 bp, synthetic construct
  misc_feature 1..39: note = nucleic acid sequence
  source 1..39: mol_type = other DNA
cccgatttagagcttcgcttaatctgtctattgttgccg

SEQ ID NO: 649 - DNA, 32 bp, synthetic construct
  misc_feature 1..32: note = nucleic acid sequence
  source 1..32: mol_type = other DNA
tactttcacgaacgtggcgagaaagtcacgct

SEQ ID NO: 650 - DNA, 38 bp, synthetic construct
  misc_feature 1..38: note = nucleic acid sequence
  source 1..38: mol_type = other DNA
tccttcgccccccgttcagcccgaccgactgggggcgt

SEQ ID NO: 651 - DNA, 37 bp, synthetic construct
  misc_feature 1..37: note = nucleic acid sequence
  source 1..37: mol_type = other DNA
atggttacgctcgtcattgacggccaagtaggaaagt

SEQ ID NO: 652 - DNA, 39 bp, synthetic construct
  misc_feature 1..39: note = nucleic acid sequence
  source 1..39: mol_type = other DNA
actgtcattgttgccatactatggtaatagcgatgacta

SEQ ID NO: 653 - DNA, 40 bp, synthetic construct
  misc_feature 1..40: note = nucleic acid sequence
  source 1..40: mol_type = other DNA
tgactggtgtagttcgcaatgggcattgatgtactgccaa

SEQ ID NO: 654 - DNA, 40 bp, synthetic construct
  misc_feature 1..40: note = nucleic acid sequence
  source 1..40: mol_type = other DNA
agaatagttctattaaggcgggccatccccgtgagtcaaa

SEQ ID NO: 655 - DNA, 38 bp, synthetic construct
  misc_feature 1..38: note = nucleic acid sequence
  source 1..38: mol_type = other DNA
tgcccggcggtcctgggaactcccattgacgtcaatgg

SEQ ID NO: 656 - DNA, 38 bp, synthetic construct
  misc_feature 1..38: note = nucleic acid sequence
  source 1..38: mol_type = other DNA
cacatagcccagccaccccgtaatcccgttgattttgg

SEQ ID NO: 657 - DNA, 38 bp, synthetic construct
  misc_feature 1..38: note = nucleic acid sequence
  source 1..38: mol_type = other DNA
tggaaaagctcaccgaataatcatggggcggagttgtt

SEQ ID NO: 658 - DNA, 36 bp, synthetic construct
  misc_feature 1..36: note = nucleic acid sequence
  source 1..36: mol_type = other DNA
caaacaacgctctgctgaaattttttaacgcacagt

SEQ ID NO: 659 - DNA, 62 bp, synthetic construct
  misc_feature 1..62: note = nucleic acid sequence
  source 1..62: mol_type = other DNA
caaggcgacgaaatcggcgttaaatttttgttaaatcagcggttagcatcccccacttggca

SEQ ID NO: 660 - DNA, 46 bp, synthetic construct
  misc_feature 1..46: note = nucleic acid sequence
  source 1..46: mol_type = other DNA
caacgataaaaaaggaacagatggtgacactatagaatagggccct

SEQ ID NO: 661 - DNA, 31 bp, synthetic construct
  misc_feature 1..31: note = nucleic acid sequence
  source 1..31: mol_type = other DNA
ccggttccaagtgggcctgggcataatgcca

SEQ ID NO: 662 - DNA, 45 bp, synthetic construct
  misc_feature 1..45: note = nucleic acid sequence
  source 1..45: mol_type = other DNA
gtttggttttctacggggtcaaacttgtacagctcgtccatgccg

SEQ ID NO: 663 - DNA, 47 bp, synthetic construct
  misc_feature 1..47: note = nucleic acid sequence
  source 1..47: mol_type = other DNA
ttgctacaaaactcactaggaaagcccggcggcggtcacgaactcca

SEQ ID NO: 664 - DNA, 46 bp, synthetic construct
  misc_feature 1..46: note = nucleic acid sequence
  source 1..46: mol_type = other DNA
ccagttaattatcaacagacaatatgtgatcgcgcttctcgttggg

SEQ ID NO: 665 - DNA, 39 bp, synthetic construct
  misc_feature 1..39: note = nucleic acid sequence
  source 1..39: mol_type = other DNA
gggaagctcgtctatcgttattgtctcatgagcggatac

SEQ ID NO: 666 - DNA, 46 bp, synthetic construct
  misc_feature 1..46: note = nucleic acid sequence
  source 1..46: mol_type = other DNA
ttgttgcctaaattaccccaccctcagggcggactgggtgctcagg

SEQ ID NO: 667 - DNA, 39 bp, synthetic construct
  misc_feature 1..39: note = nucleic acid sequence
  source 1..39: mol_type = other DNA
tccgcctcccatcaccctttttcaatattattgaagcat

SEQ ID NO: 668 - DNA, 47 bp, synthetic construct
  misc_feature 1..47: note = nucleic acid sequence
  source 1..47: mol_type = other DNA
caactttaaaagtatatcccaatcgtcgggcagcagcacggggccgt

SEQ ID NO: 669 - DNA, 40 bp, synthetic construct
  misc_feature 1..40: note = nucleic acid sequence
  source 1..40: mol_type = other DNA
ggccgagcggtgccgtgacacggaaatgttgaatactcat

SEQ ID NO: 670 - DNA, 47 bp, synthetic construct
  misc_feature 1..47: note = nucleic acid sequence
  source 1..47: mol_type = other DNA
gccggaagttaccaatcaccgcatggggtgttctgctggtagtggtc

SEQ ID NO: 671 - DNA, 39 bp, synthetic construct
  misc_feature 1..39: note = nucleic acid sequence
  source 1..39: mol_type = other DNA
atttatcaagggagccgcaaaatgccgcaaaaaagggaa

SEQ ID NO: 672 - DNA, 46 bp, synthetic construct
  misc_feature 1..46: note = nucleic acid sequence
  source 1..46: mol_type = other DNA
gctccagtcagcgatgtcacattgcacgctgccgtcctcgatgttg

SEQ ID NO: 673 - DNA, 38 bp, synthetic construct
  misc_feature 1..38: note = nucleic acid sequence
  source 1..38: mol_type = other DNA
ataccgcgaagccggccagcgtttctgggtgagcaaaa

SEQ ID NO: 674 - DNA, 53 bp, synthetic construct
  misc_feature 1..53: note = nucleic acid sequence
  source 1..53: mol_type = other DNA
tgcaatgttgcctgagcgcgtatcttgaagttcaccttgatgccgtgtggctg

SEQ ID NO: 675 - DNA, 30 bp, synthetic construct
  misc_feature 1..30: note = nucleic acid sequence
  source 1..30: mol_type = other DNA
cccagtgctgagcaaaccgtacacgcctac

SEQ ID NO: 676 - DNA, 30 bp, synthetic construct
  misc_feature 1..30: note = nucleic acid sequence
  source 1..30: mol_type = other DNA
cagattaatttaccgtatgatacacttgat

SEQ ID NO: 677 - DNA, 45 bp, synthetic construct
  misc_feature 1..45: note = nucleic acid sequence
  source 1..45: mol_type = other DNA
tggaacgaggcatcgcagtttgccgcgcacatttccccgaaaagt

SEQ ID NO: 678 - DNA, 42 bp, synthetic construct
  misc_feature 1..42: note = nucleic acid sequence
  source 1..42: mol_type = other DNA
tttttaccgtaaaaaggttgagatccagttcgatgtattttt

SEQ ID NO: 679 - DNA, 44 bp, synthetic construct
  misc_feature 1..44: note = nucleic acid sequence
  source 1..44: mol_type = other DNA
tttttcccggtaagacacgaatcgtctttgatccggcaaaaaag

SEQ ID NO: 680 - DNA, 35 bp, synthetic construct
  misc_feature 1..35: note = nucleic acid sequence
  source 1..35: mol_type = other DNA
ttttttctgcttatataataactacgatacttttt

SEQ ID NO: 681 - DNA, 46 bp, synthetic construct
  misc_feature 1..46: note = nucleic acid sequence
  source 1..46: mol_type = other DNA
tttttgtaacaggattagcagagcgaggtatcttatcgcgtggttt

SEQ ID NO: 682 - DNA, 28 bp, synthetic construct
  misc_feature 1..28: note = nucleic acid sequence
  source 1..28: mol_type = other DNA
tttttccatgatatagacgtttcttctg

SEQ ID NO: 683 - DNA, 49 bp, synthetic construct
  misc_feature 1..49: note = nucleic acid sequence
  source 1..49: mol_type = other DNA
ttttttcttgaagtggtggcctggctgatcagcgagctctaggcacggg

SEQ ID NO: 684 - DNA, 31 bp, synthetic construct
  misc_feature 1..31: note = nucleic acid sequence
  source 1..31: mol_type = other DNA
ttttttatttggtatctgaccaccgcttttt

SEQ ID NO: 685 - DNA, 60 bp, synthetic construct
  misc_feature 1..60: note = nucleic acid sequence
  source 1..60: mol_type = other DNA
ctcgccagttaccttcggaaaaagagttttttttttttggtagctctgagtccaattttt

SEQ ID NO: 686 - DNA, 63 bp, synthetic construct
  misc_feature 1..63: note = nucleic acid sequence
  source 1..63: mol_type = other DNA
tttttacccactcgtgcagaaaggagcggttttttttttgcgctagggcgcttgtcggttttt

SEQ ID NO: 687 - DNA, 49 bp, synthetic construct
  misc_feature 1..49: note = nucleic acid sequence
  source 1..49: mol_type = other DNA
atgttgtgttttgtttcgaaactacggctacactagaagaacagttttt

SEQ ID NO: 688 - DNA, 54 bp, synthetic construct
  misc_feature 1..54: note = nucleic acid sequence
  source 1..54: mol_type = other DNA
tttttgggagggcttacagaaagccccaactgatcttcagcatctttaggatct

SEQ ID NO: 689 - DNA, 36 bp, synthetic construct
  misc_feature 1..36: note = nucleic acid sequence
  source 1..36: mol_type = other DNA
ttttttggtagcgcactggcagcagccactgttttt

SEQ ID NO: 690 - DNA, 41 bp, synthetic construct
  misc_feature 1..41: note = nucleic acid sequence
  source 1..41: mol_type = other DNA
gcaagcagcagcttgccggtggcggtgctacagagtttttt

SEQ ID NO: 691 - DNA, 48 bp, synthetic construct
  misc_feature 1..48: note = nucleic acid sequence
  source 1..48: mol_type = other DNA
ctccccgttgtagttcagtgggttctctagttagccagagagcttttt

SEQ ID NO: 692 - DNA, 42 bp, synthetic construct
  misc_feature 1..42: note = nucleic acid sequence
  source 1..42: mol_type = other DNA
tcgtgtaggacctcccaaggccagcaaaaggccaggattttt

SEQ ID NO: 693 - DNA, 54 bp, synthetic construct
  misc_feature 1..54: note = nucleic acid sequence
  source 1..54: mol_type = other DNA
cgcgtatatcaatgagtgagcaaccataggcttaaatttttgttaacaaaagaa

SEQ ID NO: 694 - DNA, 32 bp, synthetic construct
  misc_feature 1..32: note = nucleic acid sequence
  source 1..32: mol_type = other DNA
cgtaaataactaatgaccccgtaaacccgaca

SEQ ID NO: 695 - DNA, 79 bp, synthetic construct
  misc_feature 1..79: note = nucleic acid sequence
  source 1..79: mol_type = other DNA
caaaacaaactcccattgacgtcggaacataaaccaccggttgaatacatgccattcaccctagggagcccccgattta

SEQ ID NO: 696 - DNA, 72 bp, synthetic construct
  misc_feature 1..72: note = nucleic acid sequence
  source 1..72: mol_type = other DNA
tcaaaccgcgcctaccgcccatttgcgtcaattttttgttaagtcccttgtaacgcggaactcctccccctg

SEQ ID NO: 697 - DNA, 60 bp, synthetic construct
  misc_feature 1..60: note = nucleic acid sequence
  source 1..60: mol_type = other DNA
gccaaaagctctgcttatatagtcctcgccggcacctcagaagtgtgtgcaaaaaagcgg

SEQ ID NO: 698 - DNA, 53 bp, synthetic construct
  misc_feature 1..53: note = nucleic acid sequence
  source 1..53: mol_type = other DNA
gactaatgtaagcagtgggttcgccagtgtggtctgacatccagtccgatcaa

SEQ ID NO: 699 - DNA, 38 bp, synthetic construct
  misc_feature 1..38: note = nucleic acid sequence
  source 1..38: mol_type = other DNA
aaagtccctatagtgagtcgtatcacactgaaatcaat

SEQ ID NO: 700 - DNA, 71 bp, synthetic construct
  misc_feature 1..71: note = nucleic acid sequence
  source 1..71: mol_type = other DNA
agttgttacgacatttacttgtggtagataacgacccacgagtgttatggctggcaactagaaggcacagt

SEQ ID NO: 701 - DNA, 48 bp, synthetic construct
  misc_feature 1..48: note = nucleic acid sequence
  source 1..48: mol_type = other DNA
tctagttattttctaccacttgataactagtcaataatcaaaaaatcg

SEQ ID NO: 702 - DNA, 40 bp, synthetic construct
  misc_feature 1..40: note = nucleic acid sequence
  source 1..40: mol_type = other DNA
taatttcgaaaactcacgtcaatagggggcgtacttggca

SEQ ID NO: 703 - DNA, 68 bp, synthetic construct
  misc_feature 1..68: note = nucleic acid sequence
  source 1..68: mol_type = other DNA
cccgccctcgccggacacgctgatggaaaggcaaacacgtcattatcagccaggcgggccgttccgac

SEQ ID NO: 704 - DNA, 38 bp, synthetic construct
  misc_feature 1..38: note = nucleic acid sequence
  source 1..38: mol_type = other DNA
ggccaggaccccggtgaacagcacctcccaaaaaaaag

SEQ ID NO: 705 - DNA, 55 bp, synthetic construct
  misc_feature 1..55: note = nucleic acid sequence
  source 1..55: mol_type = other DNA
tcatgtggtcggggtagcggctgaagcactgcacgccgtaccatctcgagcggcc

SEQ ID NO: 706 - DNA, 69 bp, synthetic construct
  misc_feature 1..69: note = nucleic acid sequence
  source 1..69: mol_type = other DNA
ttgaagttcaccttgtgtactccagcttgtgccccaggggtggtgctttatcagtagttgcctgtgact

SEQ ID NO: 707 - DNA, 47 bp, synthetic construct
  misc_feature 1..47: note = nucleic acid sequence
  source 1..47: mol_type = other DNA
cacgctgccgtcctcgatgttgtggcggatccgaggctggttgtcag

SEQ ID NO: 708 - DNA, 76 bp, synthetic construct
  misc_feature 1..76: note = nucleic acid sequence
  source 1..76: mol_type = other DNA
agtggtcggcgagctgtgacactatagaatacctactcagacaatgcgatgcaagagaaagttagctccagtcatt

SEQ ID NO: 709 - DNA, 61 bp, synthetic construct
  misc_feature 1..61: note = nucleic acid sequence
  source 1..61: mol_type = other DNA
ggccgtcgccgatgggggtgttctgctggtatgcggttcaccagggtgtcgccctcgaact

SEQ ID NO: 710 - DNA, 70 bp, synthetic construct
  misc_feature 1..70: note = nucleic acid sequence
  source 1..70: mol_type = other DNA
tcgggcagcagcacggtcacctcggcgcgggtcttgtaggtgctgctggaagctactaaagtcgccacat

SEQ ID NO: 711 - DNA, 39 bp, synthetic construct
  misc_feature 1..39: note = nucleic acid sequence
  source 1..39: mol_type = other DNA
gggccctctagattacttgtacaggcgagttacatgatc

SEQ ID NO: 712 - DNA, 62 bp, synthetic construct
  misc_feature 1..62: note = nucleic acid sequence
  source 1..62: mol_type = other DNA
gctcgtccgccccaccccaccccccagaatagggcgctagggcgctgaagagtccactatta

SEQ ID NO: 713 - DNA, 53 bp, synthetic construct
  misc_feature 1..53: note = nucleic acid sequence
  source 1..53: mol_type = other DNA
agtggcaccttccagggtcaaggaaggcacaatcggaagttatggcagcaaca

SEQ ID NO: 714 - DNA, 47 bp, synthetic construct
  misc_feature 1..47: note = nucleic acid sequence
  source 1..47: mol_type = other DNA
ttgtcttcccaatcctcccccttgctgtcctatgccgagagtgatcc

SEQ ID NO: 715 - DNA, 78 bp, synthetic construct
  misc_feature 1..78: note = nucleic acid sequence
  source 1..78: mol_type = other DNA
acggggaaagccggcgaacgtggctttcctcattttattaggaaaggacagtggggagcttgaagtaagttgcttttc

SEQ ID NO: 716 - DNA, 31 bp, synthetic construct
  misc_feature 1..31: note = nucleic acid sequence
  source 1..31: mol_type = other DNA
gaagggaagaaagcgaaaggagcgaatgaca

SEQ ID NO: 717 - DNA, 39 bp, synthetic construct
  misc_feature 1..39: note = nucleic acid sequence
  source 1..39: mol_type = other DNA
atcaagttttttgggggcatttatcttccttttgggcgg

SEQ ID NO: 718 - DNA, 53 bp, synthetic construct
  misc_feature 1..53: note = nucleic acid sequence
  source 1..53: mol_type = other DNA
tacagagttattgaatcgaggtgctctgcataattctcgggagggcttaccat

SEQ ID NO: 719 - DNA, 61 bp, synthetic construct
  misc_feature 1..61: note = nucleic acid sequence
  source 1..61: mol_type = other DNA
attgtctcatgagcggatacatagggcgacataagttaattggcgttactatgaatggggt

SEQ ID NO: 720 - DNA, 54 bp, synthetic construct
  misc_feature 1..54: note = nucleic acid sequence
  source 1..54: mol_type = other DNA
tatttagaaaaataaaaaaccgtcctcaaccattcggtccagccagccggaagg

SEQ ID NO: 721 - DNA, 77 bp, synthetic construct
  misc_feature 1..77: note = nucleic acid sequence
  source 1..77: mol_type = other DNA
cgcacatttccccgaaagaacgtcggcgaccccccatgtgtcctgcaactttatccgcctccagttacctcttgccc

SEQ ID NO: 722 - DNA, 39 bp, synthetic construct
  misc_feature 1..39: note = nucleic acid sequence
  source 1..39: mol_type = other DNA
aaagtgcctttcaccactattaatgtactgccaagtggg

SEQ ID NO: 723 - DNA, 53 bp, synthetic construct
  misc_feature 1..53: note = nucleic acid sequence
  source 1..53: mol_type = other DNA
tgtaagcgttaatattgttccagtacgggagttcccaatattaattgttgccg

SEQ ID NO: 724 - DNA, 40 bp, synthetic construct
  misc_feature 1..40: note = nucleic acid sequence
  source 1..40: mol_type = other DNA
atcagctcctgttgagcaaaaggcggcgggccatttaccg

SEQ ID NO: 725 - DNA, 53 bp, synthetic construct
  misc_feature 1..53: note = nucleic acid sequence
  source 1..53: mol_type = other DNA
cggaaatctggtagccgtcgtgccgtttaccttcagggtcagcttgttgtagt

SEQ ID NO: 726 - DNA, 47 bp, synthetic construct
  misc_feature 1..47: note = nucleic acid sequence
  source 1..47: mol_type = other DNA
gggaataatttgaatggaagctccctcgtgcgctctcctatttaccg

SEQ ID NO: 727 - DNA, 46 bp, synthetic construct
  misc_feature 1..46: note = nucleic acid sequence
  source 1..46: mol_type = other DNA
gcaaaaaaggtgagtatatcagggcgatggcccactacgtgaacca

SEQ ID NO: 728 - DNA, 62 bp, synthetic construct
  misc_feature 1..62: note = nucleic acid sequence
  source 1..62: mol_type = other DNA
caaaaacagggttccgggactataaagataccaggcgttatatatggaaatgccgcagatta

SEQ ID NO: 729 - DNA, 75 bp, synthetic construct
  misc_feature 1..75: note = nucleic acid sequence
  source 1..75: mol_type = other DNA
gggtgagagtgtatgggactccaacgtcaaagggcgaacaaatagggaaggcagctatgactccacccattgacg

SEQ ID NO: 730 - DNA, 54 bp, synthetic construct
  misc_feature 1..54: note = nucleic acid sequence
  source 1..54: mol_type = other DNA
tcttttacacctaaatacgctcaagtcagaggtggcgaattgattagcgtttct

SEQ ID NO: 731 - DNA, 53 bp, synthetic construct
  misc_feature 1..53: note = nucleic acid sequence
  source 1..53: mol_type = other DNA
cccactcaattcgcgtccgcccccctgacgagcatcacatgtcaaaactgatc

SEQ ID NO: 732 - DNA, 60 bp, synthetic construct
  misc_feature 1..60: note = nucleic acid sequence
  source 1..60: mol_type = other DNA
ccgtaagatggccgcctcaccggctccagaagatgaagtcgccgtccagctcgaccagga

SEQ ID NO: 733 - DNA, 62 bp, synthetic construct
  misc_feature 1..62: note = nucleic acid sequence
  source 1..62: mol_type = other DNA
gagttgcaatgcttactttgatcgccagagaccgcatcaccatggtaatagcgattatgata

SEQ ID NO: 734 - DNA, 61 bp, synthetic construct
  misc_feature 1..61: note = nucleic acid sequence
  source 1..61: mol_type = other DNA
tttaaaatcgtcgtttagttcgcactgggtgctcaggtagtggttgcggcggcggtcacga

SEQ ID NO: 735 - DNA, 68 bp, synthetic construct
  misc_feature 1..68: note = nucleic acid sequence
  source 1..68: mol_type = other DNA
gagtaagtggtatggcttcattcgtaaccaccacacccgccgcgcgcctgctaactccagcaggacca

SEQ ID NO: 736 - DNA, 60 bp, synthetic construct
  misc_feature 1..60: note = nucleic acid sequence
  source 1..60: mol_type = other DNA
tacgatacttactgtctcatactcagggttcctgccgcttaccggatacctcttcgggaa

SEQ ID NO: 737 - DNA, 61 bp, synthetic construct
  misc_feature 1..61: note = nucleic acid sequence
  source 1..61: mol_type = other DNA
tgactcccggtggttggggcggggagacttggaaatccccgtgagtcaatggatgcaagca

SEQ ID NO: 738 - DNA, 46 bp, synthetic construct
  misc_feature 1..46: note = nucleic acid sequence
  source 1..46: mol_type = other DNA
tcatccacaataaacctccgatcatcagcgagctctagcatttagg

SEQ ID NO: 739 - DNA, 71 bp, synthetic construct
  misc_feature 1..71: note = nucleic acid sequence
  source 1..71: mol_type = other DNA
tatttcgttgggcaccgcacgggcagcttgccatgttgccgtcctccttgaagtcgatgcccttcagctcg

SEQ ID NO: 740 - DNA, 61 bp, synthetic construct
  misc_feature 1..61: note = nucleic acid sequence
  source 1..61: mol_type = other DNA
gatctgtccgcgcagccgtacactatccacgcccattgatgtactcagtttacgatctcaa

SEQ ID NO: 741 - DNA, 54 bp, synthetic construct
  misc_feature 1..54: note = nucleic acid sequence
  source 1..54: mol_type = other DNA
atatatgagtggaacgataagccaacgtagatgtactgccaagtaggtcattga

SEQ ID NO: 742 - DNA, 69 bp, synthetic construct
  misc_feature 1..69: note = nucleic acid sequence
  source 1..69: mol_type = other DNA
gaagatcatcagtgacttgctcaggtcagggtggtcacgagggtggccgagcgatctcagcctgagaat

SEQ ID NO: 743 - DNA, 70 bp, synthetic construct
  misc_feature 1..70: note = nucleic acid sequence
  source 1..70: mol_type = other DNA
ggggtctgttcagcaggcgtcaatttggaacgcaagtgtagcggtcacgctgcgcagctccgtaataccg

SEQ ID NO: 744 - DNA, 38 bp, synthetic construct
  misc_feature 1..38: note = nucleic acid sequence
  source 1..38: mol_type = other DNA
acgctcagtaaacttgatggatatctgcagaattccag

SEQ ID NO: 745 - DNA, 62 bp, synthetic construct
  misc_feature 1..62: note = nucleic acid sequence
  source 1..62: mol_type = other DNA
cgttaagcgatgtaaagcagaactagaccgagatagggttgagtgttttgttaagtgcaccc

SEQ ID NO: 746 - DNA, 55 bp, synthetic construct
  misc_feature 1..55: note = nucleic acid sequence
  source 1..55: mol_type = other DNA
tttttaaaaaggccgcgttgctggcgtttttaaggccagatccagttggattttg

SEQ ID NO: 747 - DNA, 61 bp, synthetic construct
  misc_feature 1..61: note = nucleic acid sequence
  source 1..61: mol_type = other DNA
tttttctttctcatagctcacgggggtcgtttcaataggtagctcttgatccgtcccgttg

SEQ ID NO: 748 - DNA, 49 bp, synthetic construct
  misc_feature 1..49: note = nucleic acid sequence
  source 1..49: mol_type = other DNA
ttgacgtcaatgggcttcggtgcattttgctccaagctgggctgttttt

SEQ ID NO: 749 - DNA, 53 bp, synthetic construct
  misc_feature 1..53: note = nucleic acid sequence
  source 1..53: mol_type = other DNA
tttttgttcggtgtaggtcggctgtagaaagagttttcttgaagtggtttttt

SEQ ID NO: 750 - DNA, 53 bp, synthetic construct
  misc_feature 1..53: note = nucleic acid sequence
  source 1..53: mol_type = other DNA
ataaggtcatgtactgggttttttttttcataatgccacaggaaccgtttttt

SEQ ID NO: 751 - DNA, 73 bp, synthetic construct
  misc_feature 1..73: note = nucleic acid sequence
  source 1..73: mol_type = other DNA
tttttgtaccaagcttgattatcaaaaaggatcttttttttttttcacctagatcccaacgttgttgcttttt

SEQ ID NO: 752 - DNA, 69 bp, synthetic construct
  misc_feature 1..69: note = nucleic acid sequence
  source 1..69: mol_type = other DNA
ttttttgtgcacgaaccctgtctgctgaagccagttttttttttttaccttcggaagtatctcattttt

SEQ ID NO: 753 - DNA, 48 bp, synthetic construct
  misc_feature 1..48: note = nucleic acid sequence
  source 1..48: mol_type = other DNA
tttttacgtagccttcgagtttgcgttttaaatcattggaacttaccg

SEQ ID NO: 754 - DNA, 55 bp, synthetic construct
  misc_feature 1..55: note = nucleic acid sequence
  source 1..55: mol_type = other DNA
ttttttgcgccttatccggtaagatatagacgttgtggctgccgtaggaccgcga

SEQ ID NO: 755 - DNA, 65 bp, synthetic construct
  misc_feature 1..65: note = nucleic acid sequence
  source 1..65: mol_type = other DNA
atgccgttcttctgcttgtcggcgcaatgattggcatcgccctccgttcagcccgaccgcttttt

SEQ ID NO: 756 - DNA, 49 bp, synthetic construct
  misc_feature 1..49: note = nucleic acid sequence
  source 1..49: mol_type = other DNA
cagggcggcagttaatggcatggctactagtggatccgagctcgttttt

SEQ ID NO: 757 - DNA, 58 bp, synthetic construct
  misc_feature 1..58: note = nucleic acid sequence
  source 1..58: mol_type = other DNA
tttttgttggggtctttgcttgtgatcgatcgtggacattccgaaatcccttataaat

SEQ ID NO: 758 - DNA, 78 bp, synthetic construct
  misc_feature 1..78: note = nucleic acid sequence
  source 1..78: mol_type = other DNA
tttttcatagagcccaccgcatccccagcatttaatgtctgtcacgcgtgctcattaaaaatgtcatgagggtctccc

SEQ ID NO: 759 - DNA, 63 bp, synthetic construct
  misc_feature 1..63: note = nucleic acid sequence
  source 1..63: mol_type = other DNA
tttttcactggtaacaggattgtaaagcactaggggacttatcgccactggcagcagcttttt

SEQ ID NO: 760 - DNA, 54 bp, synthetic construct
  misc_feature 1..54: note = nucleic acid sequence
  source 1..54: mol_type = other DNA
attttttaaccaataggcttttttttttcgaaatcggcacctcagaagcttttt

SEQ ID NO: 761 - DNA, 41 bp, synthetic construct
  misc_feature 1..41: note = nucleic acid sequence
  source 1..41: mol_type = other DNA
tttttgaaaactctcaaggataacgttcttcggggcttttt

SEQ ID NO: 762 - DNA, 69 bp, synthetic construct
  misc_feature 1..69: note = nucleic acid sequence
  source 1..69: mol_type = other DNA
tttttggcctaactacggccagcagagcgaggtatttttttttttgtaggcggtgcgcgtggcgttttt

SEQ ID NO: 763 - DNA, 31 bp, synthetic construct
  misc_feature 1..31: note = nucleic acid sequence
  source 1..31: mol_type = other DNA
tttttcattgctacaggccgcttctcttttt

SEQ ID NO: 764 - DNA, 75 bp, synthetic construct
  misc_feature 1..75: note = nucleic acid sequence
  source 1..75: mol_type = other DNA
ttttttggtatctgcgcgccctagaagacccggtaagacacggaggggcaaacaacagatcactcatgccctaaa

SEQ ID NO: 765 - DNA, 52 bp, synthetic construct
  misc_feature 1..52: note = nucleic acid sequence
  source 1..52: mol_type = other DNA
ccagtgctcatctatcgtcttgagtcttttttttttcaaacagtattttttt

SEQ ID NO: 766 - DNA, 72 bp, synthetic construct
  misc_feature 1..72: note = nucleic acid sequence
  source 1..72: mol_type = other DNA
gaagttttgcggccgtggacttgaagaagtcttgccgtcgtccttgaagaagatggtgcgctcctggttttt

SEQ ID NO: 767 - DNA, 38 bp, synthetic construct; identical to SEQ ID NO: 79
  misc_feature 1..38: note = nucleic acid sequence
  source 1..38: mol_type = other DNA

SEQ ID NO: 768 - DNA, 54 bp, synthetic construct
  misc_feature 1..54: note = nucleic acid sequence
  source 1..54: mol_type = other DNA
caatgggctcttccttaaagagttgggagggcactcgccctcgccctcgccgga

SEQ ID NO: 769 - DNA, 30 bp, synthetic construct; identical to SEQ ID NO: 80
  misc_feature 1..30: note = nucleic acid sequence
  source 1..30: mol_type = other DNA

SEQ ID NO: 770 - DNA, 40 bp, synthetic construct; identical to SEQ ID NO: 82
  misc_feature 1..40: note = nucleic acid sequence
  source 1..40: mol_type = other DNA

SEQ ID NO: 771 - DNA, 54 bp, synthetic construct; identical to SEQ ID NO: 83
  misc_feature 1..54: note = nucleic acid sequence
  source 1..54: mol_type = other DNA

SEQ ID NO: 772 - DNA, 30 bp, synthetic construct
  misc_feature 1..30: note = nucleic acid sequence
  source 1..30: mol_type = other DNA
atatgatacacttgatgtactgcgatgtac

SEQ ID NO: 773 - DNA, 38 bp, synthetic construct
  misc_feature 1..38: note = nucleic acid sequence
  source 1..38: mol_type = other DNA
cgtcaatagggggcgtatagcgaataagccagtaagca

SEQ ID NO: 774 - DNA, 32 bp, synthetic construct
  misc_feature 1..32: note = nucleic acid sequence
  source 1..32: mol_type = other DNA
cccgtgagaccgtacacgcctacctccagctc

SEQ ID NO: 775 - DNA, 39 bp, synthetic construct
  misc_feature 1..39: note = nucleic acid sequence
  source 1..39: mol_type = other DNA
tcaaaccgctatccacgcccattcaagtgggaaaaaaag

SEQ ID NO: 776 - DNA, 45 bp, synthetic construct
  misc_feature 1..45: note = nucleic acid sequence
  source 1..45: mol_type = other DNA
cgacattttgatccggaacatattgggcggtcagccagctctcct

SEQ ID NO: 777 - DNA, 40 bp, synthetic construct; identical to SEQ ID NO: 91
  misc_feature 1..40: note = nucleic acid sequence
  source 1..40: mol_type = other DNA

SEQ ID NO: 778 - DNA, 54 bp, synthetic construct; identical to SEQ ID NO: 92
  misc_feature 1..54: note = nucleic acid sequence
  source 1..54: mol_type = other DNA

SEQ ID NO: 779 - DNA, 38 bp, synthetic construct; identical to SEQ ID NO: 93
  misc_feature 1..38: note = nucleic acid sequence
  source 1..38: mol_type = other DNA

SEQ ID NO: 780 - DNA, 62 bp, synthetic construct
  misc_feature 1..62: note = nucleic acid sequence
  source 1..62: mol_type = other DNA
tctagttatgccaaaaccgcatcaccatggtaacttggcttttctacaactgattcttgccc

SEQ ID NO: 781 - DNA, 37 bp, synthetic construct; identical to SEQ ID NO: 95
  misc_feature 1..37: note = nucleic acid sequence
  source 1..37: mol_type = other DNA

SEQ ID NO: 782 - DNA, 39 bp, synthetic construct
  misc_feature 1..39: note = nucleic acid sequence
  source 1..39: mol_type = other DNA
ccgtttacgtcgccggcccatttcggtggtttcaatgga

SEQ ID NO: 783 - DNA, 54 bp, synthetic construct
  misc_feature 1..54: note = nucleic acid sequence
  source 1..54: mol_type = other DNA
tgggcaccaccccggttatatagacgcgcagcagtttaccgtaaatactccacc

SEQ ID NO: 784 - DNA, 32 bp, synthetic construct; identical to SEQ ID NO: 98
  misc_feature 1..32: note = nucleic acid sequence
  source 1..32: mol_type = other DNA

SEQ ID NO: 785 - DNA, 31 bp, synthetic construct
  misc_feature 1..31: note = nucleic acid sequence
  source 1..31: mol_type = other DNA
gagcggccgtaaacttccgcctccgttccca

SEQ ID NO: 786 - DNA, 39 bp, synthetic construct; identical to SEQ ID NO: 100
  misc_feature 1..39: note = nucleic acid sequence
  source 1..39: mol_type = other DNA

SEQ ID NO: 787 - DNA, 32 bp, synthetic construct
  misc_feature 1..32: note = nucleic acid sequence
  source 1..32: mol_type = other DNA
gtgctgcttgatggatatctgcagagtcgtat

SEQ ID NO: 788 - DNA, 46 bp, synthetic construct; identical to SEQ ID NO: 101
  misc_feature 1..46: note = nucleic acid sequence
  source 1..46: mol_type = other DNA

SEQ ID NO: 789 - DNA, 47 bp, synthetic construct
  misc_feature 1..47: note = nucleic acid sequence
  source 1..47: mol_type = other DNA
gttgtagttgtactccagcttgtagcttgccgctccagattcatcca

SEQ ID NO: 790 - DNA, 48 bp, synthetic construct; identical to SEQ ID NO: 103
  misc_feature 1..48: note = nucleic acid sequence
  source 1..48: mol_type = other DNA

SEQ ID NO: 791 - DNA, 39 bp, synthetic construct; identical to SEQ ID NO: 104
  misc_feature 1..39: note = nucleic acid sequence
  source 1..39: mol_type = other DNA

SEQ ID NO: 792 - DNA, 32 bp, synthetic construct
  misc_feature 1..32: note = nucleic acid sequence
  source 1..32: mol_type = other DNA
gatgccctctgctggtagtggtcgcatttagg

SEQ ID NO: 793 - DNA, 30 bp, synthetic construct; identical to SEQ ID NO: 105
  misc_feature 1..30: note = nucleic acid sequence
  source 1..30: mol_type = other DNA

SEQ ID NO: 794 - DNA, 38 bp, synthetic construct; identical to SEQ ID NO: 106
  misc_feature 1..38: note = nucleic acid sequence
  source 1..38: mol_type = other DNA

SEQ ID NO: 795 - DNA, 54 bp, synthetic construct; identical to SEQ ID NO: 107
  misc_feature 1..54: note = nucleic acid sequence
  source 1..54: mol_type = other DNA

SEQ ID NO: 796 - DNA, 37 bp, synthetic construct; identical to SEQ ID NO: 108
  misc_feature 1..37: note = nucleic acid sequence
  source 1..37: mol_type = other DNA

SEQ ID NO: 797 - DNA, 36 bp, synthetic construct; identical to SEQ ID NO: 109
  misc_feature 1..36: note = nucleic acid sequence
  source 1..36: mol_type = other DNA

SEQ ID NO: 798 - DNA, 38 bp, synthetic construct
  misc_feature 1..38: note = nucleic acid sequence
  source 1..38: mol_type = other DNA
gatcagcgagctctaggcgagctgcagccagcgagggt

SEQ ID NO: 799 - DNA, 40 bp, synthetic construct
  misc_feature 1..40: note = nucleic acid sequence
  source 1..40: mol_type = other DNA
cttgtacagctcgtccatgccgagagtggttgctattaat

SEQ ID NO: 800 - DNA, 31 bp, synthetic construct
  misc_feature 1..31: note = nucleic acid sequence
  source 1..31: mol_type = other DNA
ccggcggcggtcacgaactccagtctttgct

SEQ ID NO: 801 - DNA, 23 bp, synthetic construct
  misc_feature 1..23: note = nucleic acid sequence
  source 1..23: mol_type = other DNA
aagcactacactcatggttacta

SEQ ID NO: 802 - DNA, 38 bp, synthetic construct
  misc_feature 1..38: note = nucleic acid sequence
  source 1..38: mol_type = other DNA
ccgatttgttgtcagccgtaagatagttgccctggtag

SEQ ID NO: 803 - DNA, 44 bp, synthetic construct
  misc_feature 1..44: note = nucleic acid sequence
  source 1..44: mol_type = other DNA
aacgtggaaaagcggctcaaccatctcagcgcagattacctccc

SEQ ID NO: 804 - DNA, 39 bp, synthetic construct; identical to SEQ ID NO: 117
  misc_feature 1..39: note = nucleic acid sequence
  source 1..39: mol_type = other DNA

SEQ ID NO: 805 - DNA, 31 bp, synthetic construct; identical to SEQ ID NO: 118
  misc_feature 1..31: note = nucleic acid sequence
  source 1..31: mol_type = other DNA

SEQ ID NO: 806 - DNA, 31 bp, synthetic construct; identical to SEQ ID NO: 120
  misc_feature 1..31: note = nucleic acid sequence
  source 1..31: mol_type = other DNA

SEQ ID NO: 807 - DNA, 39 bp, synthetic construct
  misc_feature 1..39: note = nucleic acid sequence
  source 1..39: mol_type = other DNA
tgttccaggggcgctggcaagtgtagcggtcgcttcatt

SEQ ID NO: 808 - DNA, 39 bp, synthetic construct
  misc_feature 1..39: note = nucleic acid sequence
  source 1..39: mol_type = other DNA
tagaccgagataggggttaatatacccactcgtgcaccc

SEQ ID NO: 809 - DNA, 31 bp, synthetic construct; identical to SEQ ID NO: 121
  misc_feature 1..31: note = nucleic acid sequence
  source 1..31: mol_type = other DNA

SEQ ID NO: 810 - DNA, 54 bp, synthetic construct
  misc_feature 1..54: note = nucleic acid sequence
  source 1..54: mol_type = other DNA
tcagggttattgtctcccactaccatgccataagtaaggacccacgcttgaagt

SEQ ID NO: 811 - DNA, 54 bp, synthetic construct; identical to SEQ ID NO: 122
  misc_feature 1..54: note = nucleic acid sequence
  source 1..54: mol_type = other DNA

SEQ ID NO: 812 - DNA, 46 bp, synthetic construct; identical to SEQ ID NO: 123
  misc_feature 1..46: note = nucleic acid sequence
  source 1..46: mol_type = other DNA

SEQ ID NO: 813 - DNA, 39 bp, synthetic construct
  misc_feature 1..39: note = nucleic acid sequence
  source 1..39: mol_type = other DNA
aaagtgccaaaaatcgacgctcaagtcagaggtggcgaa

SEQ ID NO: 814 - DNA, 45 bp, synthetic construct; identical to SEQ ID NO: 125
  misc_feature 1..45: note = nucleic acid sequence
  source 1..45: mol_type = other DNA

SEQ ID NO: 815 - DNA, 47 bp, synthetic construct
  misc_feature 1..47: note = nucleic acid sequence
  source 1..47: mol_type = other DNA
ggaaggctgcaagcagatctgtcgaccaggagggccagggcacgggc

SEQ ID NO: 816 - DNA, 45 bp, synthetic construct
  misc_feature 1..45: note = nucleic acid sequence
  source 1..45: mol_type = other DNA
gcgtttcctgagaataagaacggaagggaagaaagcgaaaggagc

SEQ ID NO: 817 - DNA, 45 bp, synthetic construct
  misc_feature 1..45: note = nucleic acid sequence
  source 1..45: mol_type = other DNA
tttcaccagatctcaaatgcttatcctcgccacgccgtaggtcag

SEQ ID NO: 818 - DNA, 61 bp, synthetic construct
  misc_feature 1..61: note = nucleic acid sequence
  source 1..61: mol_type = other DNA
tgcttttgcaaaaaagatacatatccccctggaagctccctcgtgcggcgggccgggcgac

SEQ ID NO: 819 - DNA, 38 bp, synthetic construct
  misc_feature 1..38: note = nucleic acid sequence
  source 1..38: mol_type = other DNA
ctgtgactaaaccgtacggggaaagccggcgcgatgca

SEQ ID NO: 820 - DNA, 62 bp, synthetic construct; identical to SEQ ID NO: 128
  misc_feature 1..62: note = nucleic acid sequence
  source 1..62: mol_type = other DNA

SEQ ID NO: 821 - DNA, 54 bp, synthetic construct
  misc_feature 1..54: note = nucleic acid sequence
  source 1..54: mol_type = other DNA
taataccgcgatgtatttgttaaccataggctccgcccccctgacgagcatcac

SEQ ID NO: 822 - DNA, 39 bp, synthetic construct
  misc_feature 1..39: note = nucleic acid sequence
  source 1..39: mol_type = other DNA
ttggccgccaacagatgagtggcaccttccagggtcaag

SEQ ID NO: 823 - DNA, 47 bp, synthetic construct
  misc_feature 1..47: note = nucleic acid sequence
  source 1..47: mol_type = other DNA
ttgtgcaacgagaaagtggactccaacgtcaaaaaataacaaaaaca

SEQ ID NO: 824 - DNA, 54 bp, synthetic construct
  misc_feature 1..54: note = nucleic acid sequence
  source 1..54: mol_type = other DNA
ccccatgtgacactatagaatagggccctcgccgatggggtcctgcaagcactg

SEQ ID NO: 825 - DNA, 31 bp, synthetic construct
  misc_feature 1..31: note = nucleic acid sequence
  source 1..31: mol_type = other DNA
ggcgagttcggcgaccagttaccagaagatc

SEQ ID NO: 826 - DNA, 31 bp, synthetic construct; identical to SEQ ID NO: 131
  misc_feature 1..31: note = nucleic acid sequence
  source 1..31: mol_type = other DNA

SEQ ID NO: 827 - DNA, 53 bp, synthetic construct; identical to SEQ ID NO: 132
  misc_feature 1..53: note = nucleic acid sequence
  source 1..53: mol_type = other DNA

SEQ ID NO: 828 - DNA, 54 bp, synthetic construct
  misc_feature 1..54: note = nucleic acid sequence
  source 1..54: mol_type = other DNA
tatttcgtttatcagcttcggtccgaggctatttcctcattttattaggaaagg

SEQ ID NO: 829 - DNA, 63 bp, synthetic construct
  misc_feature 1..63: note = nucleic acid sequence
  source 1..63: mol_type = other DNA
aggcacctaagtcatttgggtgagacaaatagacccgacaggactataaagataccaggcgtt

SEQ ID NO: 830 - DNA, 39 bp, synthetic construct; identical to SEQ ID NO: 136
  misc_feature 1..39: note = nucleic acid sequence
  source 1..39: mol_type = other DNA

SEQ ID NO: 831 - DNA, 55 bp, synthetic construct; identical to SEQ ID NO: 137
  misc_feature 1..55: note = nucleic acid sequence
  source 1..55: mol_type = other DNA

SEQ ID NO: 832 - DNA, 39 bp, synthetic construct
  misc_feature 1..39: note = nucleic acid sequence
  source 1..39: mol_type = other DNA
aaccaccgtgactccacttgtggcagatgaacttcaggg

SEQ ID NO: 833 - DNA, 45 bp, synthetic construct
  misc_feature 1..45: note = nucleic acid sequence
  source 1..45: mol_type = other DNA
ggggtctatatatgagccagtgtcatgtggtcggggtgtgtcgcc

SEQ ID NO: 834 - DNA, 31 bp, synthetic construct
  misc_feature 1..31: note = nucleic acid sequence
  source 1..31: mol_type = other DNA
gtggaacggtcattgacgcgtatatcaatga

SEQ ID NO: 835 - DNA, 46 bp, synthetic construct
  misc_feature 1..46: note = nucleic acid sequence
  source 1..46: mol_type = other DNA
aaaactcatccagttcgccacatcaaaagaacgtaaccaccacacc

SEQ ID NO: 836 - DNA, 55 bp, synthetic construct; identical to SEQ ID NO: 152
  misc_feature 1..55: note = nucleic acid sequence
  source 1..55: mol_type = other DNA

SEQ ID NO: 837 - DNA, 50 bp, synthetic construct; identical to SEQ ID NO: 153
  misc_feature 1..50: note = nucleic acid sequence
  source 1..50: mol_type = other DNA

SEQ ID NO: 838 - DNA, 27 bp, synthetic construct
  misc_feature 1..27: note = nucleic acid sequence
  source 1..27: mol_type = other DNA
tttttgtatctcagttcggttagctca

SEQ ID NO: 839 - DNA, 61 bp, synthetic construct; identical to SEQ ID NO: 155
  misc_feature 1..61: note = nucleic acid sequence
  source 1..61: mol_type = other DNA

SEQ ID NO: 840 - DNA, 40 bp, synthetic construct; identical to SEQ ID NO: 156
  misc_feature 1..40: note = nucleic acid sequence
  source 1..40: mol_type = other DNA

SEQ ID NO: 841 - DNA, 44 bp, synthetic construct; identical to SEQ ID NO: 157
  misc_feature 1..44: note = nucleic acid sequence
  source 1..44: mol_type = other DNA

SEQ ID NO: 842 - DNA, 33 bp, synthetic construct; identical to SEQ ID NO: 158
  misc_feature 1..33: note = nucleic acid sequence
  source 1..33: mol_type = other DNA

SEQ ID NO: 843 - DNA, 58 bp, synthetic construct; identical to SEQ ID NO: 159
  misc_feature 1..58: note = nucleic acid sequence
  source 1..58: mol_type = other DNA

SEQ ID NO: 844 - DNA, 43 bp, synthetic construct; identical to SEQ ID NO: 160
  misc_feature 1..43: note = nucleic acid sequence
  source 1..43: mol_type = other DNA

SEQ ID NO: 845 - DNA, 39 bp, synthetic construct; identical to SEQ ID NO: 161
  misc_feature 1..39: note = nucleic acid sequence
  source 1..39: mol_type = other DNA

SEQ ID NO: 846 - DNA, 39 bp, synthetic construct; identical to SEQ ID NO: 162
  misc_feature 1..39: note = nucleic acid sequence
  source 1..39: mol_type = other DNA

SEQ ID NO: 847 - DNA, 63 bp, synthetic construct; identical to SEQ ID NO: 163
  misc_feature 1..63: note = nucleic acid sequence
  source 1..63: mol_type = other DNA

SEQ ID NO: 848 - DNA, 31 bp, synthetic construct; identical to SEQ ID NO: 164
  misc_feature 1..31: note = nucleic acid sequence
  source 1..31: mol_type = other DNA

SEQ ID NO: 849 - DNA, 41 bp, synthetic construct; identical to SEQ ID NO: 165
  misc_feature 1..41: note = nucleic acid sequence
  source 1..41: mol_type = other DNA

SEQ ID NO: 850 - DNA, 69 bp, synthetic construct; identical to SEQ ID NO: 166
  misc_feature 1..69: note = nucleic acid sequence
  source 1..69: mol_type = other DNA

SEQ ID NO: 851 - DNA, 66 bp, synthetic construct; identical to SEQ ID NO: 167
  misc_feature 1..66: note = nucleic acid sequence
  source 1..66: mol_type = other DNA

SEQ ID NO: 852 - DNA, 38 bp, synthetic construct; identical to SEQ ID NO: 168
  misc_feature 1..38: note = nucleic acid sequence
  source 1..38: mol_type = other DNA

SEQ ID NO: 853 - DNA, 57 bp, synthetic construct; identical to SEQ ID NO: 169
  misc_feature 1..57: note = nucleic acid sequence
  source 1..57: mol_type = other DNA

SEQ ID NO: 854 - DNA, 31 bp, synthetic construct; identical to SEQ ID NO: 170
  misc_feature 1..31: note = nucleic acid sequence
  source 1..31: mol_type = other DNA

SEQ ID NO: 855 - DNA, 41 bp, synthetic construct; identical to SEQ ID NO: 171
  misc_feature 1..41: note = nucleic acid sequence
  source 1..41: mol_type = other DNA

SEQ ID NO: 856 - DNA, 31 bp, synthetic construct; identical to SEQ ID NO: 172
  misc_feature 1..31: note = nucleic acid sequence
  source 1..31: mol_type = other DNA

SEQ ID NO: 857 - DNA, 42 bp, synthetic construct; identical to SEQ ID NO: 173
  misc_feature 1..42: note = nucleic acid sequence
  source 1..42: mol_type = other DNA

SEQ ID NO: 858 - DNA, 41 bp, synthetic construct; identical to SEQ ID NO: 174
  misc_feature 1..41: note = nucleic acid sequence
  source 1..41: mol_type = other DNA

SEQ ID NO: 859 - DNA, 33 bp, synthetic construct; identical to SEQ ID NO: 175
  misc_feature 1..33: note = nucleic acid sequence
  source 1..33: mol_type = other DNA

SEQ ID NO: 860 - DNA, 28 bp, synthetic construct
  misc_feature 1..28: note = nucleic acid sequence
  source 1..28: mol_type = other DNA
tttttagccagttaccgctgtagttttt

SEQ ID NO: 861 - DNA, 26 bp, synthetic construct
  misc_feature 1..26: note = nucleic acid sequence
  source 1..26: mol_type = other DNA
cttcggaactacagagttcttttttt

SEQ ID NO: 862 - DNA, 93 bp, synthetic construct
  misc_feature 1..93: note = nucleic acid sequence
  source 1..93: mol_type = other DNA
gtaagttatgtaacgcggaactccatatatgggctatgaactaatgaccccgtaattgattactattaataactagtcaataatcaatgtcaa

SEQ ID NO: 863 - DNA, 93 bp, synthetic construct
  misc_feature 1..93: note = nucleic acid sequence
  source 1..93: mol_type = other DNA
cccagcatgcctgctattgtcttcccaatcctcccccttgctgtcctgccccaccccaccccccagaatagaatgacacctactcagacaatg

SEQ ID NO: 864 - DNA, 31 bp, synthetic construct
  misc_feature 1..31: note = nucleic acid sequence
  source 1..31: mol_type = other DNA
ggaacataacggaaatgctgaagccgtcgtg

SEQ ID NO: 865 - DNA, 62 bp, synthetic construct
  misc_feature 1..62: note = nucleic acid sequence
  source 1..62: mol_type = other DNA
cgtcattaattggcgttactatgcgcttacgacattttggaaagtcccgttgattcaatgga

SEQ ID NO: 866 - DNA, 30 bp, synthetic construct
  misc_feature 1..30: note = nucleic acid sequence
  source 1..30: mol_type = other DNA
cgtcaatagggggcgtacttggctcaaacc

SEQ ID NO: 867 - DNA, 54 bp, synthetic construct
  misc_feature 1..54: note = nucleic acid sequence
  source 1..54: mol_type = other DNA
cccataaggtcatgtatgactaatatccgagctcggtacgccagtgctagatcc

SEQ ID NO: 868 - DNA, 47 bp, synthetic construct
  misc_feature 1..47: note = nucleic acid sequence
  source 1..47: mol_type = other DNA
aatggggtagctctgcttatatagacttgtggggcacctgacccacg

SEQ ID NO: 869 - DNA, 39 bp, synthetic construct
  misc_feature 1..39: note = nucleic acid sequence
  source 1..39: mol_type = other DNA
ggagacttggaaatccccgtgagatatgatatgcaagca

SEQ ID NO: 870 - DNA, 40 bp, synthetic construct
  misc_feature 1..40: note = nucleic acid sequence
  source 1..40: mol_type = other DNA
cgcctaccgcccatttgcatcgccttcatccaatctggcc

SEQ ID NO: 871 - DNA, 54 bp, synthetic construct
  misc_feature 1..54: note = nucleic acid sequence
  source 1..54: mol_type = other DNA
ccgtacacaaaacaaactcccattgacgtccagtttacaaccaccgtgggtgag

SEQ ID NO: 872 - DNA, 38 bp, synthetic construct
  misc_feature 1..38: note = nucleic acid sequence
  source 1..38: mol_type = other DNA
gtaagcagtgggttcgaccaggaggtctgacaataaac

SEQ ID NO: 873 - DNA, 62 bp, synthetic construct
  misc_feature 1..62: note = nucleic acid sequence
  source 1..62: mol_type = other DNA
ataagccagctatccacgcccattgatgtacttcattgagatctcaacgatgtaagtgtatg

SEQ ID NO: 874 - DNA, 39 bp, synthetic construct
  misc_feature 1..39: note = nucleic acid sequence
  source 1..39: mol_type = other DNA
tatagtgagtcgtattcctcgccaaatcaatcagaagtg

SEQ ID NO: 875 - DNA, 45 bp, synthetic construct
  misc_feature 1..45: note = nucleic acid sequence
  source 1..45: mol_type = other DNA
ttcgggtcagcttgccgtaggtggcgtcaattcggaaaagtccct

SEQ ID NO: 876 - DNA, 62 bp, synthetic construct
  misc_feature 1..62: note = nucleic acid sequence
  source 1..62: mol_type = other DNA
cgccggacacgctgaacctcccaggcaaacacgtaaatactccacccattgacgtttggtgc

SEQ ID NO: 877 - DNA, 54 bp, synthetic construct
  misc_feature 1..54: note = nucleic acid sequence
  source 1..54: mol_type = other DNA
gtcgccgtccagctctctagttatttttgttcacttgatgtactgccaagtggg

SEQ ID NO: 878 - DNA, 32 bp, synthetic construct
  misc_feature 1..32: note = nucleic acid sequence
  source 1..32: mol_type = other DNA
caccccggtgaacagctaatttcgaaaaaaag

SEQ ID NO: 879 - DNA, 31 bp, synthetic construct
  misc_feature 1..31: note = nucleic acid sequence
  source 1..31: mol_type = other DNA
tgatggattgcgctcctggacgtctcgaact

SEQ ID NO: 880 - DNA, 32 bp, synthetic construct
  misc_feature 1..32: note = nucleic acid sequence
  source 1..32: mol_type = other DNA
ggcatggcaccatctcgagcggcccaagcttg

SEQ ID NO: 881 - DNA, 46 bp, synthetic construct
  misc_feature 1..46: note = nucleic acid sequence
  source 1..46: mol_type = other DNA
cttgtcggatgttgtggcggatcagggtcaagttgtcagggtcgag

SEQ ID NO: 882 - DNA, 47 bp, synthetic construct
  misc_feature 1..47: note = nucleic acid sequence
  source 1..47: mol_type = other DNA
gccatgatatagacgttgtggctcgagggtgtaccgcgaatctcagc

SEQ ID NO: 883 - DNA, 32 bp, synthetic construct
  misc_feature 1..32: note = nucleic acid sequence
  source 1..32: mol_type = other DNA
gttgtagtagtggtcggcgagctgcaacagat

SEQ ID NO: 884 - DNA, 39 bp, synthetic construct
  misc_feature 1..39: note = nucleic acid sequence
  source 1..39: mol_type = other DNA
tgtactccagcttgtgccccaggaagcactgtttatcag

SEQ ID NO: 885 - DNA, 32 bp, synthetic construct
  misc_feature 1..32: note = nucleic acid sequence
  source 1..32: mol_type = other DNA
atgttgccgggccgtcgccgatggcgaggctg

SEQ ID NO: 886 - DNA, 30 bp, synthetic construct
  misc_feature 1..30: note = nucleic acid sequence
  source 1..30: mol_type = other DNA
tcagctcgctcaggtagtggttgtgacact

SEQ ID NO: 887 - DNA, 46 bp, synthetic construct
  misc_feature 1..46: note = nucleic acid sequence
  source 1..46: mol_type = other DNA
cagcacggtcctccttgaagtcgatgccctgtgctgctgccgagcg

SEQ ID NO: 888 - DNA, 54 bp, synthetic construct
  misc_feature 1..54: note = nucleic acid sequence
  source 1..54: mol_type = other DNA
actgggtgatgcggttcaccagggtgtcgccagccttcgccgcctccttttaaa

SEQ ID NO: 889 - DNA, 37 bp, synthetic construct
  misc_feature 1..37: note = nucleic acid sequence
  source 1..37: mol_type = other DNA
gttggggtctttgctttgtacaatcgtgggggcgctg

SEQ ID NO: 890 - DNA, 23 bp, synthetic construct
  misc_feature 1..23: note = nucleic acid sequence
  source 1..23: mol_type = other DNA
ttttttggaagtaagttggcgag

SEQ ID NO: 891 - DNA, 31 bp, synthetic construct
  misc_feature 1..31: note = nucleic acid sequence
  source 1..31: mol_type = other DNA
cgtaaccatcattttttaaccaatttgttaa

SEQ ID NO: 892 - DNA, 31 bp, synthetic construct
  misc_feature 1..31: note = nucleic acid sequence
  source 1..31: mol_type = other DNA
gcgatggcccactacgctcatactgggcgac

SEQ ID NO: 893 - DNA, 39 bp, synthetic construct
  misc_feature 1..39: note = nucleic acid sequence
  source 1..39: mol_type = other DNA
tagaccgagaaagcgaaaggagcgggcgctatgtcacgc

SEQ ID NO: 894 - DNA, 39 bp, synthetic construct
  misc_feature 1..39: note = nucleic acid sequence
  source 1..39: mol_type = other DNA
aaatcccttataaataaagtgccctgttgagatccagtt

SEQ ID NO: 895 - DNA, 54 bp, synthetic construct
  misc_feature 1..54: note = nucleic acid sequence
  source 1..54: mol_type = other DNA
tttcaatattattgaaaaaccgtgcactgcattcggtcccagtgctccgtcctc

SEQ ID NO: 896 - DNA, 30 bp, synthetic construct
  misc_feature 1..30: note = nucleic acid sequence
  source 1..30: mol_type = other DNA
gcatttaggaaggcaaaatgccggtagctc

SEQ ID NO: 897 - DNA, 54 bp, synthetic construct
  misc_feature 1..54: note = nucleic acid sequence
  source 1..54: mol_type = other DNA
attgtctcatgagcggaagaacgtccgtaagaccccatgctcaccggtgctggt

SEQ ID NO: 898 - DNA, 30 bp, synthetic construct
  misc_feature 1..30: note = nucleic acid sequence
  source 1..30: mol_type = other DNA
atacatatttcaccagcgtttcctggtagc

SEQ ID NO: 899 - DNA, 46 bp, synthetic construct
  misc_feature 1..46: note = nucleic acid sequence
  source 1..46: mol_type = other DNA
tatttagaaaaataatgttccagctcaaccagttcccaacagccag

SEQ ID NO: 900 - DNA, 31 bp, synthetic construct
  misc_feature 1..31: note = nucleic acid sequence
  source 1..31: mol_type = other DNA
acaaataggtgcacccaactgatcgcagatt

SEQ ID NO: 901 - DNA, 45 bp, synthetic construct
  misc_feature 1..45: note = nucleic acid sequence
  source 1..45: mol_type = other DNA
cgcacatttccccgacaaaagaacggcgactcgtcgttgtcctgc

SEQ ID NO: 902 - DNA, 45 bp, synthetic construct
  misc_feature 1..45: note = nucleic acid sequence
  source 1..45: mol_type = other DNA
ttcagcaggtgagtatttggaaagccggcgaacgtggcgagaaag

SEQ ID NO: 903 - DNA, 32 bp, synthetic construct
  misc_feature 1..32: note = nucleic acid sequence
  source 1..32: mol_type = other DNA
ttcggggcgaaaactcgacgctcaatcttcac

SEQ ID NO: 904 - DNA, 54 bp, synthetic construct
  misc_feature 1..54: note = nucleic acid sequence
  source 1..54: mol_type = other DNA
ttactgtcaaaaacatcagggttggactataaagataccaggcgtttccccctg

SEQ ID NO: 905 - DNA, 38 bp, synthetic construct
  misc_feature 1..38: note = nucleic acid sequence
  source 1..38: mol_type = other DNA
catgccatggactccgggagcccccgatttagagcttg

SEQ ID NO: 906 - DNA, 62 bp, synthetic construct
  misc_feature 1..62: note = nucleic acid sequence
  source 1..62: mol_type = other DNA
cgagttgcttaaaaatctttgatcggtctcccccgcatcaccatggtaatagcgactgggca

SEQ ID NO: 907 - DNA, 54 bp, synthetic construct
  misc_feature 1..54: note = nucleic acid sequence
  source 1..54: mol_type = other DNA
tcttgccccttaccgacctaaataaggccgcgttgctggcgtttttccataggc

SEQ ID NO: 908 - DNA, 31 bp, synthetic construct
  misc_feature 1..31: note = nucleic acid sequence
  source 1..31: mol_type = other DNA
taataccgaaaaagggtggaacgactagtgg

SEQ ID NO: 909 - DNA, 52 bp, synthetic construct
  misc_feature 1..52: note = nucleic acid sequence
  source 1..52: mol_type = other DNA
ctccgatcggaaggcacgggggaggggcaaacacgctggcaatgaggccagg

SEQ ID NO: 910 - DNA, 31 bp, synthetic construct
  misc_feature 1..31: note = nucleic acid sequence
  source 1..31: mol_type = other DNA
ttagctcctaattctcgatctgtcttgatcc

SEQ ID NO: 911 - DNA, 32 bp, synthetic construct
  misc_feature 1..32: note = nucleic acid sequence
  source 1..32: mol_type = other DNA
aaaagcggaccctaaaaacgtcaaagggcgaa

SEQ ID NO: 912 - DNA, 53 bp, synthetic construct
  misc_feature 1..53: note = nucleic acid sequence
  source 1..53: mol_type = other DNA
ttgtgcaaggctggcaactagaaggcacagtgggtgttcctccagacacgccg

SEQ ID NO: 913 - DNA, 37 bp, synthetic construct
  misc_feature 1..37: note = nucleic acid sequence
  source 1..37: mol_type = other DNA
acatgatctgcttttaatgcttaggtggttgccagag

SEQ ID NO: 914 - DNA, 32 bp, synthetic construct
  misc_feature 1..32: note = nucleic acid sequence
  source 1..32: mol_type = other DNA
ggcgagttacggggaacaagagtccactatta

SEQ ID NO: 915 - DNA, 54 bp, synthetic construct
  misc_feature 1..54: note = nucleic acid sequence
  source 1..54: mol_type = other DNA
cgatcaaatcagcgagctctagcatttaggtcgggcagccggaaggtcatgtgg

SEQ ID NO: 916 - DNA, 31 bp, synthetic construct
  misc_feature 1..31: note = nucleic acid sequence
  source 1..31: mol_type = other DNA
cagctccgagtcattatatatgaacgcgcag

SEQ ID NO: 917 - DNA, 31 bp, synthetic construct
  misc_feature 1..31: note = nucleic acid sequence
  source 1..31: mol_type = other DNA
gcttcattgaagggaagatagggttgagtgt

SEQ ID NO: 918 - DNA, 47 bp, synthetic construct
  misc_feature 1..47: note = nucleic acid sequence
  source 1..47: mol_type = other DNA
tggtatgatagaatagggccctctagattaccagggcggaactttat

SEQ ID NO: 919 - DNA, 46 bp, synthetic construct
  misc_feature 1..46: note = nucleic acid sequence
  source 1..46: mol_type = other DNA
atccagtctacaggcgctcgtccatgccgagagtgatctgtgatcg

SEQ ID NO: 920 - DNA, 53 bp, synthetic construct
  misc_feature 1..53: note = nucleic acid sequence
  source 1..53: mol_type = other DNA
tagttgccctcatgggggaataacttccttgaagctccctcgtgcgctctccc

SEQ ID NO: 921 - DNA, 31 bp, synthetic construct
  misc_feature 1..31: note = nucleic acid sequence
  source 1..31: mol_type = other DNA
tatttcgctcgccctgcacgggcagcttgcc

SEQ ID NO: 922 - DNA, 32 bp, synthetic construct
  misc_feature 1..32: note = nucleic acid sequence
  source 1..32: mol_type = other DNA
atcagtgaccgtttactaggtcagggtggtca

SEQ ID NO: 923 - DNA, 63 bp, synthetic construct
  misc_feature 1..63: note = nucleic acid sequence
  source 1..63: mol_type = other DNA
cagttaccctgtgacttcttttactttgaatgacgctcaagtcagaggtggcgaaacccgaca

SEQ ID NO: 924 - DNA, 30 bp, synthetic construct
  misc_feature 1..30: note = nucleic acid sequence
  source 1..30: mol_type = other DNA
gtaaactttgggcactcggggtagcggctg

SEQ ID NO: 925 - DNA, 62 bp, synthetic construct
  misc_feature 1..62: note = nucleic acid sequence
  source 1..62: mol_type = other DNA
ctaaagtctgagaatacccactcgggttccgtccgcccccctgacgagcatcacaaaaatcg

SEQ ID NO: 926 - DNA, 55 bp, synthetic construct
  misc_feature 1..55: note = nucleic acid sequence
  source 1..55: mol_type = other DNA
aaagagttgcaaaaaattatggcactatcagggtgccgtaaagcactaaatcgga

SEQ ID NO: 927 - DNA, 37 bp, synthetic construct
  misc_feature 1..37: note = nucleic acid sequence
  source 1..37: mol_type = other DNA
gaagatcgaagttttcttgctcggacttgaagaagtc

SEQ ID NO: 928 - DNA, 39 bp, synthetic construct
  misc_feature 1..39: note = nucleic acid sequence
  source 1..39: mol_type = other DNA
ttttctactaatgccaggcgggccatttaccggccaaaa

SEQ ID NO: 929 - DNA, 46 bp, synthetic construct
  misc_feature 1..46: note = nucleic acid sequence
  source 1..46: mol_type = other DNA
ggggtcttcaaggatggcgtcaaaatcggcagcaagtgtagcggtc

SEQ ID NO: 930 - DNA, 62 bp, synthetic construct
  misc_feature 1..62: note = nucleic acid sequence
  source 1..62: mol_type = other DNA
tttttagcaaaaggccagcaaaaggccaggaaccgtaaatgtaagcgttaatattaggccga

SEQ ID NO: 931 - DNA, 50 bp, synthetic construct
  misc_feature 1..50: note = nucleic acid sequence
  source 1..50: mol_type = other DNA
tttttgtccgcctttctccctgcttaccggattaggttgaatatgaacca

SEQ ID NO: 932 - DNA, 27 bp, synthetic construct
  misc_feature 1..27: note = nucleic acid sequence
  source 1..27: mol_type = other DNA
tttttctttctcatagctcatcgggaa

SEQ ID NO: 933 - DNA, 53 bp, synthetic construct
  misc_feature 1..53: note = nucleic acid sequence
  source 1..53: mol_type = other DNA
acgtagatgtactgccaattttttttttgtaggaaagttcaatgagtgttttt

SEQ ID NO: 934 - DNA, 40 bp, synthetic construct
  misc_feature 1..40: note = nucleic acid sequence
  source 1..40: mol_type = other DNA
tttttctggcggccgttaaaactcacgttaagggattttt

SEQ ID NO: 935 - DNA, 44 bp, synthetic construct
  misc_feature 1..44: note = nucleic acid sequence
  source 1..44: mol_type = other DNA
ttttttttttgtgtaggtcgtagacactagaagaacagtttttt

SEQ ID NO: 936 - DNA, 33 bp, synthetic construct
  misc_feature 1..33: note = nucleic acid sequence
  source 1..33: mol_type = other DNA
tttttgtcgtccttgaaggaagctaagattatc

SEQ ID NO: 937 - DNA, 58 bp, synthetic construct
  misc_feature 1..58: note = nucleic acid sequence
  source 1..58: mol_type = other DNA
tttttttttttgcacgaaccccccgccttgatgccgttcttctgggtggtggcttacc

SEQ ID NO: 938 - DNA, 35 bp, synthetic construct
  misc_feature 1..35: note = nucleic acid sequence
  source 1..35: mol_type = other DNA
tttttactccagcaggaccaccggcggctttgcgc

SEQ ID NO: 939 - DNA, 39 bp, synthetic construct
  misc_feature 1..39: note = nucleic acid sequence
  source 1..39: mol_type = other DNA
tttttgcgccttatccggtaatggcaccttccttgaagt

SEQ ID NO: 940 - DNA, 47 bp, synthetic construct
  misc_feature 1..47: note = nucleic acid sequence
  source 1..47: mol_type = other DNA
tttttcgcgcttaatgtcacattccgcctcaacgctgcgaacgttgt

SEQ ID NO: 941 - DNA, 63 bp, synthetic construct
  misc_feature 1..63: note = nucleic acid sequence
  source 1..63: mol_type = other DNA
ttttttaagacacgacttatcccctaatcaaggagctatcgtcttgagtccaacccggttttt

SEQ ID NO: 942 - DNA, 31 bp, synthetic construct
  misc_feature 1..31: note = nucleic acid sequence
  source 1..31: mol_type = other DNA
tttttgttaaatcagcccacacccgcttttt

SEQ ID NO: 943 - DNA, 41 bp, synthetic construct
  misc_feature 1..41: note = nucleic acid sequence
  source 1..41: mol_type = other DNA
tttttgtgctcatcattggaaagcagaactttaaaattttt

SEQ ID NO: 944 - DNA, 69 bp, synthetic construct
  misc_feature 1..69: note = nucleic acid sequence
  source 1..69: mol_type = other DNA
tttttgtaggcggtgcttcagccactggcagcagcttttttttttcactggtaacaggatacctttttt

SEQ ID NO: 945 - DNA, 66 bp, synthetic construct
  misc_feature 1..66: note = nucleic acid sequence
  source 1..66: mol_type = other DNA
acacgcagtgttatcatgactccccagttacctggggcggagttgtgtaggtatctcagttttttt

SEQ ID NO: 946 - DNA, 64 bp, synthetic construct
  misc_feature 1..64: note = nucleic acid sequence
  source 1..64: mol_type = other DNA
tacgggatgccattgctattaatcgcttctctcacctcggcgcgggtcttgtagttgccttttt

SEQ ID NO: 947 - DNA, 38 bp, synthetic construct
  misc_feature 1..38: note = nucleic acid sequence
  source 1..38: mol_type = other DNA
cgccacataacgttcaattcgcgttaaatttttttttt

SEQ ID NO: 948 - DNA, 31 bp, synthetic construct
  misc_feature 1..31: note = nucleic acid sequence
  source 1..31: mol_type = other DNA
tttttcgccagttaatagggtcacgattttt

SEQ ID NO: 949 - DNA, 41 bp, synthetic construct
  misc_feature 1..41: note = nucleic acid sequence
  source 1..41: mol_type = other DNA
tttttctaactacggctatattcttgaagtggtggcttttt

SEQ ID NO: 950 - DNA, 31 bp, synthetic construct
  misc_feature 1..31: note = nucleic acid sequence
  source 1..31: mol_type = other DNA
actacgattcattcagcccgaccgctttttt

SEQ ID NO: 951 - DNA, 42 bp, synthetic construct
  misc_feature 1..42: note = nucleic acid sequence
  source 1..42: mol_type = other DNA
acgggaggcagatgaacttcagctccaagctgggctgttttt

SEQ ID NO: 952 - DNA, 41 bp, synthetic construct
  misc_feature 1..41: note = nucleic acid sequence
  source 1..41: mol_type = other DNA
tgttgccggaagatggatctgcagaattccagcacattttt

SEQ ID NO: 953 - DNA, 33 bp, synthetic construct
  misc_feature 1..33: note = nucleic acid sequence
  source 1..33: mol_type = other DNA
tttttttttggtcatggagtaagtagttttttt

SEQ ID NO: 954 - DNA, 28 bp, synthetic construct
  misc_feature 1..28: note = nucleic acid sequence
  source 1..28: mol_type = other DNA
tttttatttggtatcgcgtggcgttttt

SEQ ID NO: 955 - DNA, 26 bp, synthetic construct
  misc_feature 1..26: note = nucleic acid sequence
  source 1..26: mol_type = other DNA
tgcgctctcagagcgaggtatttttt

SEQ ID NO: 956 - DNA, 154 bp, synthetic construct
  misc_feature 1..154: note = nucleic acid sequence
  source 1..154: mol_type = other DNA
ttgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacgcgtata

SEQ ID NO: 957 - DNA, 154 bp, synthetic construct
  misc_feature 1..154: note = nucleic acid sequence
  source 1..154: mol_type = other DNA
gaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgg

SEQ ID NO: 958 - DNA, 30 bp, synthetic construct
  misc_feature 1..30: note = nucleic acid sequence
  source 1..30: mol_type = other DNA
tcagaggggcgagaaaggaaggataaatca

SEQ ID NO: 959 - DNA, 30 bp, synthetic construct
  misc_feature 1..30: note = nucleic acid sequence
  source 1..30: mol_type = other DNA
agataccttagagcttgacgggggagtgtt

SEQ ID NO: 960 - DNA, 31 bp, synthetic construct
  misc_feature 1..31: note = nucleic acid sequence
  source 1..31: mol_type = other DNA
tacctgtcaggcgggccatttacctgacgtc

SEQ ID NO: 961 - DNA, 32 bp, synthetic construct
  misc_feature 1..32: note = nucleic acid sequence
  source 1..32: mol_type = other DNA
atcaatgaaaaatcgacgctcaagcttatccg

SEQ ID NO: 962 - DNA, 39 bp, synthetic construct
  misc_feature 1..39: note = nucleic acid sequence
  source 1..39: mol_type = other DNA
tacggccatttaccgtcattgacgtcaataggcaaaagg

SEQ ID NO: 963 - DNA, 32 bp, synthetic construct
  misc_feature 1..32: note = nucleic acid sequence
  source 1..32: mol_type = other DNA
ggggcgtatcccataaggtcatgttgggtctc

SEQ ID NO: 964 - DNA, 54 bp, synthetic construct
  misc_feature 1..54: note = nucleic acid sequence
  source 1..54: mol_type = other DNA
cttggcatatgatacacttgatgtactgccaaatacgtagatgtaccgataagc

SEQ ID NO: 965 - DNA, 62 bp, synthetic construct
  misc_feature 1..62: note = nucleic acid sequence
  source 1..62: mol_type = other DNA
agtgggcagtttaccgtaaatactccacccaaaaccgcatcaccattagccagaagtcgagg

SEQ ID NO: 966 - DNA, 39 bp, synthetic construct
  misc_feature 1..39: note = nucleic acid sequence
  source 1..39: mol_type = other DNA
accgctatccacgcccaccgtacaaacaacagatggggg

SEQ ID NO: 967 - DNA, 53 bp, synthetic construct
  misc_feature 1..53: note = nucleic acid sequence
  source 1..53: mol_type = other DNA
gggtggagacttggaatggggcgccagggtagctgcacgaagcattaaaaggg

SEQ ID NO: 968 - DNA, 31 bp, synthetic construct
  misc_feature 1..31: note = nucleic acid sequence
  source 1..31: mol_type = other DNA
tcttccgagctcggtaccaagctactgggca

SEQ ID NO: 969 - DNA, 61 bp, synthetic construct
  misc_feature 1..61: note = nucleic acid sequence
  source 1..61: mol_type = other DNA
cttatatagacctcccattgatgtactgccattgacgtcaatggaaagtccctattggcgt

SEQ ID NO: 970 - DNA, 38 bp, synthetic construct
  misc_feature 1..38: note = nucleic acid sequence
  source 1..38: mol_type = other DNA
atatctggagtcgtattaattttgccaagtttccgcct

SEQ ID NO: 971 - DNA, 39 bp, synthetic construct
  misc_feature 1..39: note = nucleic acid sequence
  source 1..39: mol_type = other DNA
tcaccatcagtgggttctctagtggtaatagcgatgact

SEQ ID NO: 972 - DNA, 64 bp, synthetic construct
  misc_feature 1..64: note = nucleic acid sequence
  source 1..64: mol_type = other DNA
tacgtcgcccgcccatttgcgtcaaatccccgtgagtcaatactatgggaacatacgtcattat

SEQ ID NO: 973 - DNA, 30 bp, synthetic construct
  misc_feature 1..30: note = nucleic acid sequence
  source 1..30: mol_type = other DNA
gtgcgctccctcggcgcgggtctactctca

SEQ ID NO: 974 - DNA, 63 bp, synthetic construct
  misc_feature 1..63: note = nucleic acid sequence
  source 1..63: mol_type = other DNA
ctggacgtagccttcgggcatggtgtgatggggggtcttctatagaaaatcccttgaagaaag

SEQ ID NO: 975 - DNA, 32 bp, synthetic construct
  misc_feature 1..32: note = nucleic acid sequence
  source 1..32: mol_type = other DNA
cggacttgcggttcaccagggtgtcagttcga

SEQ ID NO: 976 - DNA, 62 bp, synthetic construct
  misc_feature 1..62: note = nucleic acid sequence
  source 1..62: mol_type = other DNA
aagaagtcgtgctgcttcatgtggcccttgcaggtagtgctgatcagatagggttaaagccg

SEQ ID NO: 977 - DNA, 32 bp, synthetic construct
  misc_feature 1..32: note = nucleic acid sequence
  source 1..32: mol_type = other DNA
gtcggggtctccttgaagtcgatgtgatcttc

SEQ ID NO: 978 - DNA, 32 bp, synthetic construct
  misc_feature 1..32: note = nucleic acid sequence
  source 1..32: mol_type = other DNA
taggtcagactccagcttgtgccctttctggg

SEQ ID NO: 979 - DNA, 31 bp, synthetic construct
  misc_feature 1..31: note = nucleic acid sequence
  source 1..31: mol_type = other DNA
gcacgggctgatatagacgttgttgccgcaa

SEQ ID NO: 980 - DNA, 60 bp, synthetic construct
  misc_feature 1..60: note = nucleic acid sequence
  source 1..60: mol_type = other DNA
tagttgtggtggtcacgagggtgggccaggtggccgttgtcggcgcaaggaagcgtcaaa

SEQ ID NO: 981 - DNA, 63 bp, synthetic construct
  misc_feature 1..63: note = nucleic acid sequence
  source 1..63: mol_type = other DNA
ccagcaggcagctcgcattttttctggcaagaattaaaagacacgacttatcgccactgggta

SEQ ID NO: 982 - DNA, 46 bp, synthetic construct
  misc_feature 1..46: note = nucleic acid sequence
  source 1..46: mol_type = other DNA
gttgtcgaaacaaatagcatcttaccgagttgctcttgcccggcgt

SEQ ID NO: 983 - DNA, 30 bp, synthetic construct
  misc_feature 1..30: note = nucleic acid sequence
  source 1..30: mol_type = other DNA
cgtcgccgatggctgagagtccaaagggag

SEQ ID NO: 984 - DNA, 39 bp, synthetic construct
  misc_feature 1..39: note = nucleic acid sequence
  source 1..39: mol_type = other DNA
gctgccgtgtcggccaagcttgccggtggtgcagatgaa

SEQ ID NO: 985 - DNA, 31 bp, synthetic construct
  misc_feature 1..31: note = nucleic acid sequence
  source 1..31: mol_type = other DNA
cctcgatcctcgccgtacgacattttggaaa

SEQ ID NO: 986 - DNA, 54 bp, synthetic construct
  misc_feature 1..54: note = nucleic acid sequence
  source 1..54: mol_type = other DNA
tacttgtaaccatgtgattttgtaggatcttaagtgctcatcattggaaaacgt

SEQ ID NO: 987 - DNA, 32 bp, synthetic construct
  misc_feature 1..32: note = nucleic acid sequence
  source 1..32: mol_type = other DNA
ctctagatcctatagtcagaattccagcacac

SEQ ID NO: 988 - DNA, 62 bp, synthetic construct
  misc_feature 1..62: note = nucleic acid sequence
  source 1..62: mol_type = other DNA
aggtgacatgctcaggaaaagtgtgtaacccgataataccgcgccacatagcagggtatggc

SEQ ID NO: 989 - DNA, 38 bp, synthetic construct
  misc_feature 1..38: note = nucleic acid sequence
  source 1..38: mol_type = other DNA
gcaactagaaggcacgagctctgggtgaacagctcctc

SEQ ID NO: 990 - DNA, 37 bp, synthetic construct
  misc_feature 1..37: note = nucleic acid sequence
  source 1..37: mol_type = other DNA
gcacgggggaggggcacgcctacgtccagctcgacca

SEQ ID NO: 991 - DNA, 30 bp, synthetic construct
  misc_feature 1..30: note = nucleic acid sequence
  source 1..30: mol_type = other DNA
ggcaccttgagttgtgacacgctgaacttg

SEQ ID NO: 992 - DNA, 38 bp, synthetic construct
  misc_feature 1..38: note = nucleic acid sequence
  source 1..38: mol_type = other DNA
aaccaccaccaggaacataggctccgcccccccggtaa

SEQ ID NO: 993 - DNA, 54 bp, synthetic construct
  misc_feature 1..54: note = nucleic acid sequence
  source 1..54: mol_type = other DNA
cacccgcctagggcgaaccaataagtagttctcacgctcgtcgtttaactttaa

SEQ ID NO: 994 - DNA, 31 bp, synthetic construct
  misc_feature 1..31: note = nucleic acid sequence
  source 1..31: mol_type = other DNA
tgtagcgggtttttcccgtaaaaaggccgcg

SEQ ID NO: 995 - DNA, 39 bp, synthetic construct
  misc_feature 1..39: note = nucleic acid sequence
  source 1..39: mol_type = other DNA
gaaccctactattaaaaccagcctagctccttcggtcct

SEQ ID NO: 996 - DNA, 55 bp, synthetic construct
  misc_feature 1..55: note = nucleic acid sequence
  source 1..55: mol_type = other DNA
aggtgccggcctgactgctgtaggtatctcagttcggtgctcgtgcgctaaatcg

SEQ ID NO: 997 - DNA, 40 bp, synthetic construct
  misc_feature 1..40: note = nucleic acid sequence
  source 1..40: mol_type = other DNA
tggggtcggggcgaaaacgctcacagtaagttggccgcag

SEQ ID NO: 998 - DNA, 39 bp, synthetic construct
  misc_feature 1..39: note = nucleic acid sequence
  source 1..39: mol_type = other DNA
taaaattctcgtggtggccagttaatagttttcctttta

SEQ ID NO: 999 - DNA, 38 bp, synthetic construct
  misc_feature 1..38: note = nucleic acid sequence
  source 1..38: mol_type = other DNA
aattgtaaatcggcaatagggccatgtcacaaggaaag

SEQ ID NO: 1000 - DNA, 30 bp, synthetic construct
  misc_feature 1..30: note = nucleic acid sequence
  source 1..30: mol_type = other DNA
ccacctattcattcaattgttgccgggaag

SEQ ID NO: 1001 - DNA, 29 bp, synthetic construct
  misc_feature 1..29: note = nucleic acid sequence
  source 1..29: mol_type = other DNA
aggggttcgagttagcaactttatccgcc

SEQ ID NO: 1002 - DNA, 54 bp, synthetic construct
  misc_feature 1..54: note = nucleic acid sequence
  source 1..54: mol_type = other DNA
agaaaaatggcagcagtgccgtcagcggctgaagcactgcacgccgggatgggc

SEQ ID NO: 1003 - DNA, 30 bp, synthetic construct
  misc_feature 1..30: note = nucleic acid sequence
  source 1..30: mol_type = other DNA
tatttgaaaagcggtagccggaagggccga

SEQ ID NO: 1004 - DNA, 62 bp, synthetic construct
  misc_feature 1..62: note = nucleic acid sequence
  source 1..62: mol_type = other DNA
cggatacatgagcaaaccaagtcattctgagaatagtgtgtgcaaaatgtatttttggaaca

SEQ ID NO: 1005 - DNA, 32 bp, synthetic construct
  misc_feature 1..32: note = nucleic acid sequence
  source 1..32: mol_type = other DNA
tatcagggttgtcagacggctccagatttatc

SEQ ID NO: 1006 - DNA, 30 bp, synthetic construct
  misc_feature 1..30: note = nucleic acid sequence
  source 1..30: mol_type = other DNA
accgctgttgagatccgccctcttctcgtt

SEQ ID NO: 1007 - DNA, 30 bp, synthetic construct
  misc_feature 1..30: note = nucleic acid sequence
  source 1..30: mol_type = other DNA
actcgtgcacccaaccccttcagggtgctc

SEQ ID NO: 1008 - DNA, 39 bp, synthetic construct
  misc_feature 1..39: note = nucleic acid sequence
  source 1..39: mol_type = other DNA
ttactttcaccagcgcaggatgtcacggggcaccacccc

SEQ ID NO: 1009 - DNA, 38 bp, synthetic construct
  misc_feature 1..38: note = nucleic acid sequence
  source 1..38: mol_type = other DNA
tactcaaaacaggaaggcaaaaggctgttgtggtagtg

SEQ ID NO: 1010 - DNA, 46 bp, synthetic construct
  misc_feature 1..46: note = nucleic acid sequence
  source 1..46: mol_type = other DNA
agatgcttttctgtgactggtgagccgatcgttattgtgactccaa

SEQ ID NO: 1011 - DNA, 31 bp, synthetic construct
  misc_feature 1..31: note = nucleic acid sequence
  source 1..31: mol_type = other DNA
atccgtaaataagggcgacacggttctgctt

SEQ ID NO: 1012 - DNA, 62 bp, synthetic construct
  misc_feature 1..62: note = nucleic acid sequence
  source 1..62: mol_type = other DNA
gatcaaggccgcgcacagaccgagcgagctctagcatttcagtaagctcgagcggccgccag

SEQ ID NO: 1013 - DNA, 31 bp, synthetic construct
  misc_feature 1..31: note = nucleic acid sequence
  source 1..31: mol_type = other DNA
gtctattagctccggttcccaaccaatacgg

SEQ ID NO: 1014 - DNA, 32 bp, synthetic construct
  misc_feature 1..32: note = nucleic acid sequence
  source 1..32: mol_type = other DNA
gtggtcctcatgatcccccatgttatgcggcg

SEQ ID NO: 1015 - DNA, 30 bp, synthetic construct
  misc_feature 1..30: note = nucleic acid sequence
  source 1..30: mol_type = other DNA
gctgcaatgataccgcactacgacctaatc

SEQ ID NO: 1016 - DNA, 53 bp, synthetic construct
  misc_feature 1..53: note = nucleic acid sequence
  source 1..53: mol_type = other DNA
atgaagttttaaatcctagagtaggccgaagcgttaatatcgcgcgaacttca

SEQ ID NO: 1017 - DNA, 38 bp, synthetic construct
  misc_feature 1..38: note = nucleic acid sequence
  source 1..38: mol_type = other DNA
aatctaaacgaaaggacatcacagtgagcaaaaggcca

SEQ ID NO: 1018 - DNA, 54 bp, synthetic construct
  misc_feature 1..54: note = nucleic acid sequence
  source 1..54: mol_type = other DNA
gtatatatgtaactatcgtcttgagtccaacctgacgaggcgggcgcgcgctta

SEQ ID NO: 1019 - DNA, 54 bp, synthetic construct
  misc_feature 1..54: note = nucleic acid sequence
  source 1..54: mol_type = other DNA
gagtaaacttggtcttccatccaaaagaatatttccccggcggactgctcgatg

SEQ ID NO: 1020 - DNA, 48 bp, synthetic construct
  misc_feature 1..48: note = nucleic acid sequence
  source 1..48: mol_type = other DNA
gacagttagcgaacgttggcgaaacccgacaggactataaacgaaccc

SEQ ID NO: 1021 - DNA, 30 bp, synthetic construct
  misc_feature 1..30: note = nucleic acid sequence
  source 1..30: mol_type = other DNA
ccaatgccccgttcagcccgaccgctgcgc

SEQ ID NO: 1022 - DNA, 32 bp, synthetic construct
  misc_feature 1..32: note = nucleic acid sequence
  source 1..32: mol_type = other DNA
ttaatcagtgaggcacgcgcagaagttccagt

SEQ ID NO: 1023 - DNA, 47 bp, synthetic construct
  misc_feature 1..47: note = nucleic acid sequence
  source 1..47: mol_type = other DNA
ctatctcacccccgataggcgtttccccctggaagctcctaggtcgt

SEQ ID NO: 1024 - DNA, 30 bp, synthetic construct
  misc_feature 1..30: note = nucleic acid sequence
  source 1..30: mol_type = other DNA
gcgatcttcgctccaagctgggctgtgtgc

SEQ ID NO: 1025 - DNA, 47 bp, synthetic construct
  misc_feature 1..47: note = nucleic acid sequence
  source 1..47: mol_type = other DNA
gtctatttcgttcatcagcaataagaacgtgctcatgagtgttctgc

SEQ ID NO: 1026 - DNA, 45 bp, synthetic construct
  misc_feature 1..45: note = nucleic acid sequence
  source 1..45: mol_type = other DNA
catagtttaaagcactctcctgttccgaccctgccgctagctcac

SEQ ID NO: 1027 - DNA, 38 bp, synthetic construct
  misc_feature 1..38: note = nucleic acid sequence
  source 1..38: mol_type = other DNA
ccccgtcgtgtagatagagacccaaccgtcttattatt

SEQ ID NO: 1028 - DNA, 55 bp, synthetic construct
  misc_feature 1..55: note = nucleic acid sequence
  source 1..55: mol_type = other DNA
tttttccttcgggaagcgtggcgctttctcattaccggaaagtttttacacctac

SEQ ID NO: 1029 - DNA, 41 bp, synthetic construct
  misc_feature 1..41: note = nucleic acid sequence
  source 1..41: mol_type = other DNA
tttttcgaggtatgtaggcggacaggattagcagagttttt

SEQ ID NO: 1030 - DNA, 33 bp, synthetic construct
  misc_feature 1..33: note = nucleic acid sequence
  source 1..33: mol_type = other DNA
ttgctggctcagtttgcaagcagcagatttttt

SEQ ID NO: 1031 - DNA, 30 bp, synthetic construct
  misc_feature 1..30: note = nucleic acid sequence
  source 1..30: mol_type = other DNA
tttttgcggtcagcccgcctttctcttttt

SEQ ID NO: 1032 - DNA, 41 bp, synthetic construct
  misc_feature 1..41: note = nucleic acid sequence
  source 1..41: mol_type = other DNA
tttttgaagtggtggcctaactgctacagagttcttttttt

SEQ ID NO: 1033 - DNA, 30 bp, synthetic construct
  misc_feature 1..30: note = nucleic acid sequence
  source 1..30: mol_type = other DNA
ccattgatgcgatgcaatttcctcattttt

SEQ ID NO: 1034 - DNA, 41 bp, synthetic construct
  misc_feature 1..41: note = nucleic acid sequence
  source 1..41: mol_type = other DNA
tttttgtgccaaaacaaactcgtcccgttgattttgttttt

SEQ ID NO: 1035 - DNA, 41 bp, synthetic construct
  misc_feature 1..41: note = nucleic acid sequence
  source 1..41: mol_type = other DNA
tttttacagtatttggtatcctccggcaaacaaaccttttt

SEQ ID NO: 1036 - DNA, 40 bp, synthetic construct
  misc_feature 1..40: note = nucleic acid sequence
  source 1..40: mol_type = other DNA
ccctcgcgttgtggcaaaggacagatggcccactattttt

SEQ ID NO: 1037 - DNA, 41 bp, synthetic construct
  misc_feature 1..41: note = nucleic acid sequence
  source 1..41: mol_type = other DNA
tttttgccgtaggtggcatcgcttcagggtcagcttttttt

SEQ ID NO: 1038 - DNA, 48 bp, synthetic construct
  misc_feature 1..48: note = nucleic acid sequence
  source 1..48: mol_type = other DNA
tttttcagttaccttcggaaaatcgtccttgaagaagatgtggcggcc

SEQ ID NO: 1039 - DNA, 40 bp, synthetic construct
  misc_feature 1..40: note = nucleic acid sequence
  source 1..40: mol_type = other DNA
tttttttcaccttgatgccgttcaaatgttgaatattttt

SEQ ID NO: 1040 - DNA, 31 bp, synthetic construct
  misc_feature 1..31: note = nucleic acid sequence
  source 1..31: mol_type = other DNA
tttttcttgacggatctcaagaagatttttt

SEQ ID NO: 1041 - DNA, 40 bp, synthetic construct
  misc_feature 1..40: note = nucleic acid sequence
  source 1..40: mol_type = other DNA
cacgaactgttactagtggagcgctctgctgaagcttttt

SEQ ID NO: 1042 - DNA, 48 bp, synthetic construct
  misc_feature 1..48: note = nucleic acid sequence
  source 1..48: mol_type = other DNA
gtgggagttcagacaacgtcaatgaatgggcgggggtcgttggttttt

SEQ ID NO: 1043 - DNA, 31 bp, synthetic construct
  misc_feature 1..31: note = nucleic acid sequence
  source 1..31: mol_type = other DNA
tttttttttattaggggatcttgaagttttt

SEQ ID NO: 1044 - DNA, 40 bp, synthetic construct
  misc_feature 1..40: note = nucleic acid sequence
  source 1..40: mol_type = other DNA
tttttaccgctggtagcggtggtttttttcgcgagagtga

SEQ ID NO: 1045 - DNA, 39 bp, synthetic construct
  misc_feature 1..39: note = nucleic acid sequence
  source 1..39: mol_type = other DNA
tgcgcgttaatgccaggcgggctacactagaagattttt

SEQ ID NO: 1046 - DNA, 42 bp, synthetic construct
  misc_feature 1..42: note = nucleic acid sequence
  source 1..42: mol_type = other DNA
tttttcgtgaaccatcactacgggagggcttaccatcttttt

SEQ ID NO: 1047 - DNA, 40 bp, synthetic construct
  misc_feature 1..40: note = nucleic acid sequence
  source 1..40: mol_type = other DNA
ttttttacgcgcagaaattggattttggtcatgagttttt

SEQ ID NO: 1048 - DNA, 26 bp, synthetic construct
  misc_feature 1..26: note = nucleic acid sequence
  source 1..26: mol_type = other DNA
tttttctcatactcttccactcatgg

SEQ ID NO: 1049 - DNA, 41 bp, synthetic construct
  misc_feature 1..41: note = nucleic acid sequence
  source 1..41: mol_type = other DNA
tttttcctttgatcttttctactcggggcgaaatgtagttg

SEQ ID NO: 1050 - DNA, 54 bp, synthetic construct
  misc_feature 1..54: note = nucleic acid sequence
  source 1..54: mol_type = other DNA
tttttctgcataattctcttactgtcatgcctgttatctttttcaaatcagggc

SEQ ID NO: 1051 - DNA, 62 bp, synthetic construct
  misc_feature 1..62: note = nucleic acid sequence
  source 1..62: mol_type = other DNA
tttttaaaactcacgttaaggttgccattgctctggggtctgacgctcagtggaacgttttt

SEQ ID NO: 1052 - DNA, 52 bp, synthetic construct
  misc_feature 1..52: note = nucleic acid sequence
  source 1..52: mol_type = other DNA
tacaggcagcgttaaatttttaggcggcggtccgagagttggtagctttttt

SEQ ID NO: 1053 - DNA, 31 bp, synthetic construct
  misc_feature 1..31: note = nucleic acid sequence
  source 1..31: mol_type = other DNA
ttttttggccccagtttatggcagcattttt

SEQ ID NO: 1054 - DNA, 62 bp, synthetic construct
  misc_feature 1..62: note = nucleic acid sequence
  source 1..62: mol_type = other DNA
tttttattatcaaaaaggatcttcacctagagcgcaacgaaagttaaatcagcttccatgcc

SEQ ID NO: 1055 - DNA, 200 bp, synthetic construct
  misc_feature 1..200: note = nucleic acid sequence
  source 1..200: mol_type = other DNA
gtaagttatgtaacgcggaactccatatatgggctatgaactaatgaccccgtaattgattactattaataactagtcaataatcaatgtcaacgcgtatcagaagccatagagcccaccgcatccccagcatgcctgctattgtcttcccaatcctcccccttgctgtcctgccccaccccaccccccagaatagaatg

SEQ ID NO: 1056 - DNA, 39 bp, synthetic construct
  misc_feature 1..39: note = nucleic acid sequence
  source 1..39: mol_type = other DNA
gaagctccctcgtgcgctgagtagaagggcgcaaaccac

SEQ ID NO: 1057 - DNA, 38 bp, synthetic construct
  misc_feature 1..38: note = nucleic acid sequence
  source 1..38: mol_type = other DNA
gactataaagataccgggtggggcaggaagtttgcaag

SEQ ID NO: 1058 - DNA, 37 bp, synthetic construct
  misc_feature 1..37: note = nucleic acid sequence
  source 1..37: mol_type = other DNA
ccgcccccctgacgagtgggcttcgtgcacacggggt

SEQ ID NO: 1059 - DNA, 38 bp, synthetic construct
  misc_feature 1..38: note = nucleic acid sequence
  source 1..38: mol_type = other DNA
cgtttttcaaaattcgcgttaaaccttataaatagcag

SEQ ID NO: 1060 - DNA, 30 bp, synthetic construct
  misc_feature 1..30: note = nucleic acid sequence
  source 1..30: mol_type = other DNA
gtgtcatccgtgccttccttgaccgaccac

SEQ ID NO: 1061 - DNA, 30 bp, synthetic construct
  misc_feature 1..30: note = nucleic acid sequence
  source 1..30: mol_type = other DNA
aatagcagagctcgctgatcagctacctga

SEQ ID NO: 1062 - DNA, 40 bp, synthetic construct
  misc_feature 1..40: note = nucleic acid sequence
  source 1..40: mol_type = other DNA
aggccagcgcatggacgagctgtatgctggaggacaccct

SEQ ID NO: 1063 - DNA, 54 bp, synthetic construct
  misc_feature 1..54: note = nucleic acid sequence
  source 1..54: mol_type = other DNA
tcccactgtcctttcgtgaacatcgaggacggcagcgtgcagctcgccctggaa

SEQ ID NO: 1064 - DNA, 32 bp, synthetic construct
  misc_feature 1..32: note = nucleic acid sequence
  source 1..32: mol_type = other DNA
cccctccctctattctggggggtgaggcgttt

SEQ ID NO: 1065 - DNA, 39 bp, synthetic construct
  misc_feature 1..39: note = nucleic acid sequence
  source 1..39: mol_type = other DNA
agttgccagccatctcgacggccccacaacgtctatatc

SEQ ID NO: 1066 - DNA, 32 bp, synthetic construct
  misc_feature 1..32: note = nucleic acid sequence
  source 1..32: mol_type = other DNA
tgccttctgcaagggggaggattgtggcgaaa

SEQ ID NO: 1067 - DNA, 32 bp, synthetic construct
  misc_feature 1..32: note = nucleic acid sequence
  source 1..32: mol_type = other DNA
aatgctaggcatgctggggatgcggcatcaca

SEQ ID NO: 1068 - DNA, 54 bp, synthetic construct
  misc_feature 1..54: note = nucleic acid sequence
  source 1..54: mol_type = other DNA
ctatagtgaccccaagcatcgacttcaaggtgcccgaagagtaaacatccgcct

SEQ ID NO: 1069 - DNA, 32 bp, synthetic construct
  misc_feature 1..32: note = nucleic acid sequence
  source 1..32: mol_type = other DNA
gctgcccgacaaccacctcgactgagaaaaaa

SEQ ID NO: 1070 - DNA, 38 bp, synthetic construct
  misc_feature 1..38: note = nucleic acid sequence
  source 1..38: mol_type = other DNA
gagcaaagtcacctatcttttctccaactggctcttgc

SEQ ID NO: 1071 - DNA, 40 bp, synthetic construct
  misc_feature 1..40: note = nucleic acid sequence
  source 1..40: mol_type = other DNA
aagaacggcatcaaggggcccaccccccgtcggataccgc

SEQ ID NO: 1072 - DNA, 54 bp, synthetic construct
  misc_feature 1..54: note = nucleic acid sequence
  source 1..54: mol_type = other DNA
caagcagtaccagcagaacacccccatcgggttgtttgtttttttggcaaaatg

SEQ ID NO: 1073 - DNA, 38 bp, synthetic construct
  misc_feature 1..38: note = nucleic acid sequence
  source 1..38: mol_type = other DNA
ggggcacaagctggaatgaagcataatcaggggccgag

SEQ ID NO: 1074 - DNA, 39 bp, synthetic construct
  misc_feature 1..39: note = nucleic acid sequence
  source 1..39: mol_type = other DNA
cgcatcgacagtggaatctagaggtctgaggcgaatgag

SEQ ID NO: 1075 - DNA, 37 bp, synthetic construct
  misc_feature 1..37: note = nucleic acid sequence
  source 1..37: mol_type = other DNA
ggtgaaccttcttcatgaagttcgggaaggctcgtcg

SEQ ID NO: 1076 - DNA, 52 bp, synthetic construct
  misc_feature 1..52: note = nucleic acid sequence
  source 1..52: mol_type = other DNA
gtgcccttgaactttcttgatggtgccacattgcatcgcattgtctctcctg

SEQ ID NO: 1077 - DNA, 31 bp, synthetic construct
  misc_feature 1..31: note = nucleic acid sequence
  source 1..31: mol_type = other DNA
caccctgacctacggatggccgaagcggtgg

SEQ ID NO: 1078 - DNA, 32 bp, synthetic construct
  misc_feature 1..32: note = nucleic acid sequence
  source 1..32: mol_type = other DNA
ttcttcaagtccgccaaggacggctcctttga

SEQ ID NO: 1079 - DNA, 38 bp, synthetic construct
  misc_feature 1..38: note = nucleic acid sequence
  source 1..38: mol_type = other DNA
aagttcacgctaccccgaccacgtacaactttacgcgc

SEQ ID NO: 1080 - DNA, 39 bp, synthetic construct
  misc_feature 1..39: note = nucleic acid sequence
  source 1..39: mol_type = other DNA
cccatcctgcaactttttggtctaccgagttatcttcag

SEQ ID NO: 1081 - DNA, 46 bp, synthetic construct
  misc_feature 1..46: note = nucleic acid sequence
  source 1..46: mol_type = other DNA
acggtggtcgtaacaactccgccttgacgtcgcagtgtttaaatcg

SEQ ID NO: 1082 - DNA, 39 bp, synthetic construct
  misc_feature 1..39: note = nucleic acid sequence
  source 1..39: mol_type = other DNA
tataagcagagctctcgagggcgcggctccacgttcatc

SEQ ID NO: 1083 - DNA, 48 bp, synthetic construct
  misc_feature 1..48: note = nucleic acid sequence
  source 1..48: mol_type = other DNA
ctggctaaggcaccaaaatcaacgactgcccatcctccgattagagct

SEQ ID NO: 1084 - DNA, 39 bp, synthetic construct
  misc_feature 1..39: note = nucleic acid sequence
  source 1..39: mol_type = other DNA
ctagagaacccactgcttactggacggccacagccggaa

SEQ ID NO: 1085 - DNA, 30 bp, synthetic construct
  misc_feature 1..30: note = nucleic acid sequence
  source 1..30: mol_type = other DNA
aagtctcaattaatacgactcactataggg

SEQ ID NO: 1086 - DNA, 38 bp, synthetic construct
  misc_feature 1..38: note = nucleic acid sequence
  source 1..38: mol_type = other DNA
cggtttgactcacggtgacggtcaacgatcgcgggcgc

SEQ ID NO: 1087 - DNA, 54 bp, synthetic construct
  misc_feature 1..54: note = nucleic acid sequence
  source 1..54: mol_type = other DNA
gtggataggcttggtaccgagctcggatccacaagggcgattgttgcttaaatc

SEQ ID NO: 1088 - DNA, 37 bp, synthetic construct
  misc_feature 1..37: note = nucleic acid sequence
  source 1..37: mol_type = other DNA
gttttggcagtacatcagtacatttggtatcacgctg

SEQ ID NO: 1089 - DNA, 36 bp, synthetic construct
  misc_feature 1..36: note = nucleic acid sequence
  source 1..36: mol_type = other DNA
gagtatttacggtaaggactttcgctcacatgccac

SEQ ID NO: 1090 - DNA, 48 bp, synthetic construct
  misc_feature 1..48: note = nucleic acid sequence
  source 1..48: mol_type = other DNA
attatgcccaatgggcgtctattaaggagctgtccaggagcgcaccat

SEQ ID NO: 1091 - DNA, 47 bp, synthetic construct
  misc_feature 1..47: note = nucleic acid sequence
  source 1..47: mol_type = other DNA
tgaccttaagtaatcaattacggggtcattatgtagcggtggcttca

SEQ ID NO: 1092 - DNA, 30 bp, synthetic construct
  misc_feature 1..30: note = nucleic acid sequence
  source 1..30: mol_type = other DNA
aacgccataaagcacatcactcatggtaac

SEQ ID NO: 1093 - DNA, 54 bp, synthetic construct
  misc_feature 1..54: note = nucleic acid sequence
  source 1..54: mol_type = other DNA
ccgcccattgacgtcaccccgattcgttgtcatccgtaacatagttgcgctggt

SEQ ID NO: 1094 - DNA, 38 bp, synthetic construct
  misc_feature 1..38: note = nucleic acid sequence
  source 1..38: mol_type = other DNA
accgcccgtacatcaagtgtatcatgggagtaccagcc

SEQ ID NO: 1095 - DNA, 48 bp, synthetic construct
  misc_feature 1..48: note = nucleic acid sequence
  source 1..48: mol_type = other DNA
cataacttcccctattgacgtcaaggatttccgtggtcctggtcgagc

SEQ ID NO: 1096 - DNA, 39 bp, synthetic construct
  misc_feature 1..39: note = nucleic acid sequence
  source 1..39: mol_type = other DNA
ccaccacattattaattgggactttcctactttaccatg

SEQ ID NO: 1097 - DNA, 39 bp, synthetic construct
  misc_feature 1..39: note = nucleic acid sequence
  source 1..39: mol_type = other DNA
catcaccctaatcaagtattattgtactcatatgaggaa

SEQ ID NO: 1098 - DNA, 31 bp, synthetic construct
  misc_feature 1..31: note = nucleic acid sequence
  source 1..31: mol_type = other DNA
gtctatcagggcgatgtcatgagaagggaat

SEQ ID NO: 1099 - DNA, 30 bp, synthetic construct
  misc_feature 1..30: note = nucleic acid sequence
  source 1..30: mol_type = other DNA
ccaacgtcgaaaaatagcaaaaacaggaca

SEQ ID NO: 1100 - DNA, 31 bp, synthetic construct
  misc_feature 1..31: note = nucleic acid sequence
  source 1..31: mol_type = other DNA
agtttggaacaagagatttcccccatctttt

SEQ ID NO: 1101 - DNA, 31 bp, synthetic construct
  misc_feature 1..31: note = nucleic acid sequence
  source 1..31: mol_type = other DNA
gaaatcggcaaaatctttttgttgatcttac

SEQ ID NO: 1102 - DNA, 54 bp, synthetic construct
  misc_feature 1..54: note = nucleic acid sequence
  source 1..54: mol_type = other DNA
tatttgaatgtatttaaaagggcgctggtgagggttagcagcaataattgtttt

SEQ ID NO: 1103 - DNA, 46 bp, synthetic construct
  misc_feature 1..46: note = nucleic acid sequence
  source 1..46: mol_type = other DNA
aggggttccgcgcactccactatatagtgtattacatgacgcagaa

SEQ ID NO: 1104 - DNA, 53 bp, synthetic construct
  misc_feature 1..53: note = nucleic acid sequence
  source 1..53: mol_type = other DNA
gaaaagtgaaaatcgacgctcaagtcagaggggaagacactttcacaggatct

SEQ ID NO: 1105 - DNA, 45 bp, synthetic construct
  misc_feature 1..45: note = nucleic acid sequence
  source 1..45: mol_type = other DNA
ccacctaaattgtaaggttgagtccggcgtttcagctcccatcca

SEQ ID NO: 1106 - DNA, 37 bp, synthetic construct
  misc_feature 1..37: note = nucleic acid sequence
  source 1..37: mol_type = other DNA
cagcgttttctgagataaagaaaggaagggaagaaag

SEQ ID NO: 1107 - DNA, 31 bp, synthetic construct
  misc_feature 1..31: note = nucleic acid sequence
  source 1..31: mol_type = other DNA
ttctgtgaaaaaacctgacggggaaagccgg

SEQ ID NO: 1108 - DNA, 62 bp, synthetic construct
  misc_feature 1..62: note = nucleic acid sequence
  source 1..62: mol_type = other DNA
caatacggaatctaaactgacgctgctgaaggcgagaagcgcgatcacatggtcccaagtaa

SEQ ID NO: 1109 - DNA, 44 bp, synthetic construct
  misc_feature 1..44: note = nucleic acid sequence
  source 1..44: mol_type = other DNA
tcccccaagtacgcacggtaaatggcccgcctggctgcgaacgt

SEQ ID NO: 1110 - DNA, 46 bp, synthetic construct
  misc_feature 1..46: note = nucleic acid sequence
  source 1..46: mol_type = other DNA
cggttccaaatggcccccatatatggagttccgcgttacgaaagga

SEQ ID NO: 1111 - DNA, 31 bp, synthetic construct
  misc_feature 1..31: note = nucleic acid sequence
  source 1..31: mol_type = other DNA
ggcatcgtaactttaaccttttaagggattt

SEQ ID NO: 1112 - DNA, 53 bp, synthetic construct
  misc_feature 1..53: note = nucleic acid sequence
  source 1..53: mol_type = other DNA
tgtagatacataattatgttgaaaagcattttccgaccctgccgcttaccggc

SEQ ID NO: 1113 - DNA, 31 bp, synthetic construct
  misc_feature 1..31: note = nucleic acid sequence
  source 1..31: mol_type = other DNA
cctgactctcgtgacctacggcaagctgacc

SEQ ID NO: 1114 - DNA, 32 bp, synthetic construct
  misc_feature 1..32: note = nucleic acid sequence
  source 1..32: mol_type = other DNA
gcgatctggcttcagcgcgtgtccggcgaggg

SEQ ID NO: 1115 - DNA, 38 bp, synthetic construct
  misc_feature 1..38: note = nucleic acid sequence
  source 1..38: mol_type = other DNA
gtatatatggctacgttcaccggggtggtgagacccaa

SEQ ID NO: 1116 - DNA, 39 bp, synthetic construct
  misc_feature 1..39: note = nucleic acid sequence
  source 1..39: mol_type = other DNA
aattaaaaaaggacgagctcgagatggtgagctagtaac

SEQ ID NO: 1117 - DNA, 55 bp, synthetic construct
  misc_feature 1..55: note = nucleic acid sequence
  source 1..55: mol_type = other DNA
ccggcaaaacacggaactcttactacgtgaacgaaccctaaagggagcataatga

SEQ ID NO: 1118 - DNA, 47 bp, synthetic construct
  misc_feature 1..47: note = nucleic acid sequence
  source 1..47: mol_type = other DNA
ctaataaaactcttccaaaaagagacgggagtgccggcaagctgccc

SEQ ID NO: 1119 - DNA, 46 bp, synthetic construct
  misc_feature 1..46: note = nucleic acid sequence
  source 1..46: mol_type = other DNA
cgtgcagttctatttgatttatctccttcggcttggcaaacgaccc

SEQ ID NO: 1120 - DNA, 40 bp, synthetic construct
  misc_feature 1..40: note = nucleic acid sequence
  source 1..40: mol_type = other DNA
tgacgtcaatatgccatgttgtgcggcgagaacgtggact

SEQ ID NO: 1121 - DNA, 39 bp, synthetic construct
  misc_feature 1..39: note = nucleic acid sequence
  source 1..39: mol_type = other DNA
gttgttcctagggcgctggcaaggttcatagcgcctggc

SEQ ID NO: 1122 - DNA, 47 bp, synthetic construct
  misc_feature 1..47: note = nucleic acid sequence
  source 1..47: mol_type = other DNA
aatagaccgagataggcgttaattaacccacctatggctgccctatt

SEQ ID NO: 1123 - DNA, 62 bp, synthetic construct
  misc_feature 1..62: note = nucleic acid sequence
  source 1..62: mol_type = other DNA
tatcagggttattgtcgcccactgtcatgccagaagtagagacccaccaaaatggaggtcta

SEQ ID NO: 1124 - DNA, 30 bp, synthetic construct
  misc_feature 1..30: note = nucleic acid sequence
  source 1..30: mol_type = other DNA
gatgcttccgcaaaacggatacaccccctg

SEQ ID NO: 1125 - DNA, 31 bp, synthetic construct
  misc_feature 1..31: note = nucleic acid sequence
  source 1..31: mol_type = other DNA
gataatacttcgatgattttgttcataggct

SEQ ID NO: 1126 - DNA, 32 bp, synthetic construct
  misc_feature 1..32: note = nucleic acid sequence
  source 1..32: mol_type = other DNA
agttggccaatgggtgcgtatgttcccatagt

SEQ ID NO: 1127 - DNA, 44 bp, synthetic construct
  misc_feature 1..44: note = nucleic acid sequence
  source 1..44: mol_type = other DNA
aaaaaagctactcaactatctcacagcagaacaacagccgtgct

SEQ ID NO: 1128 - DNA, 55 bp, synthetic construct
  misc_feature 1..55: note = nucleic acid sequence
  source 1..55: mol_type = other DNA
aaggcgagtgcggcggacagttacaagaagaaacatcctgcacccagtccgccct

SEQ ID NO: 1129 - DNA, 40 bp, synthetic construct
  misc_feature 1..40: note = nucleic acid sequence
  source 1..40: mol_type = other DNA
tgaggcacccaagtcatctgggtgaaacaaatcccgacag

SEQ ID NO: 1130 - DNA, 46 bp, synthetic construct
  misc_feature 1..46: note = nucleic acid sequence
  source 1..46: mol_type = other DNA
ccaatgctgcacgactggacggcgacgtaacttatcgacaccccat

SEQ ID NO: 1131 - DNA, 38 bp, synthetic construct
  misc_feature 1..38: note = nucleic acid sequence
  source 1..38: mol_type = other DNA
cgaaaacagatccagcgcgccacatcaaaagcgcgtaa

SEQ ID NO: 1132 - DNA, 55 bp, synthetic construct
  misc_feature 1..55: note = nucleic acid sequence
  source 1..55: mol_type = other DNA
tttttgaaccgtaaaaaggccgcgttgctggtgagcaaacgctgttgtcacgtta

SEQ ID NO: 1133 - DNA, 50 bp, synthetic construct
  misc_feature 1..50: note = nucleic acid sequence
  source 1..50: mol_type = other DNA
tttttaagcgtggcgctttctctttctctaggcggtttttcaattttttg

SEQ ID NO: 1134 - DNA, 27 bp, synthetic construct
  misc_feature 1..27: note = nucleic acid sequence
  source 1..27: mol_type = other DNA
tttttaggtatctcagttcgcatagct

SEQ ID NO: 1135 - DNA, 61 bp, synthetic construct
  misc_feature 1..61: note = nucleic acid sequence
  source 1..61: mol_type = other DNA
tcgagggcttcgtgaccgccgccgggttttttttttatcactctcgaaaaggccagttttt

SEQ ID NO: 1136 - DNA, 40 bp, synthetic construct
  misc_feature 1..40: note = nucleic acid sequence
  source 1..40: mol_type = other DNA
tttttccgaggtgaagttggtcatgagattatcaattttt

SEQ ID NO: 1137 - DNA, 41 bp, synthetic construct
  misc_feature 1..41: note = nucleic acid sequence
  source 1..41: mol_type = other DNA
tttttagctgggctgtgggcgtatctgcgctctgctttttt

SEQ ID NO: 1138 - DNA, 33 bp, synthetic construct
  misc_feature 1..33: note = nucleic acid sequence
  source 1..33: mol_type = other DNA
ttttttatccatcacacgccagttaacctagat

SEQ ID NO: 1139 - DNA, 55 bp, synthetic construct
  misc_feature 1..55: note = nucleic acid sequence
  source 1..55: mol_type = other DNA
tttttgcccgaccgctgcgcctaaatgggcggtaggcgtgtctgaagtctgcaat

SEQ ID NO: 1140 - DNA, 43 bp, synthetic construct
  misc_feature 1..43: note = nucleic acid sequence
  source 1..43: mol_type = other DNA
ttttttattagtcatcgctatggcagtatgctacagcttaatg

SEQ ID NO: 1141 - DNA, 39 bp, synthetic construct
  misc_feature 1..39: note = nucleic acid sequence
  source 1..39: mol_type = other DNA
tttttgtcttgagtccaacccgggactttccaccattga

SEQ ID NO: 1142 - DNA, 39 bp, synthetic construct
  misc_feature 1..39: note = nucleic acid sequence
  source 1..39: mol_type = other DNA
tttttacgcgttgacattgattattgactagcccgccgc

SEQ ID NO: 1143 - DNA, 63 bp, synthetic construct
  misc_feature 1..63: note = nucleic acid sequence
  source 1..63: mol_type = other DNA
ttttttggcagcagccactggtcgaggtgccgataggtaagacacgacttatcgccacttttt

SEQ ID NO: 1144 - DNA, 31 bp, synthetic construct
  misc_feature 1..31: note = nucleic acid sequence
  source 1..31: mol_type = other DNA
tttttaccaataggcctcacagatatttttt

SEQ ID NO: 1145 - DNA, 41 bp, synthetic construct
  misc_feature 1..41: note = nucleic acid sequence
  source 1..41: mol_type = other DNA
ttttttcttcggggcgaaaacatcattggaaaacgtttttt

SEQ ID NO: 1146 - DNA, 69 bp, synthetic construct
  misc_feature 1..69: note = nucleic acid sequence
  source 1..69: mol_type = other DNA
tttttttgaagtggtgggggtaacaggattagcagttttttttttagcgaggtatgccttcgggttttt

SEQ ID NO: 1147 - DNA, 66 bp, synthetic construct
  misc_feature 1..66: note = nucleic acid sequence
  source 1..66: mol_type = other DNA
ccttatggcagcactgactacgatttggtagccaagatccgccactaggtcgttcgctccattttt

SEQ ID NO: 1148 - DNA, 38 bp, synthetic construct
  misc_feature 1..38: note = nucleic acid sequence
  source 1..38: mol_type = other DNA
aagtgctctctcaagaaatcagctcattttttattttt

SEQ ID NO: 1149 - DNA, 57 bp, synthetic construct
  misc_feature 1..57: note = nucleic acid sequence
  source 1..57: mol_type = other DNA
ggtgtcacctagagtagtgatgcgggccgccagtgtgctggaattctgcagattttt

SEQ ID NO: 1150 - DNA, 31 bp, synthetic construct
  misc_feature 1..31: note = nucleic acid sequence
  source 1..31: mol_type = other DNA
tttttacgttgttgccatcatctacgttttt

SEQ ID NO: 1151 - DNA, 41 bp, synthetic construct
  misc_feature 1..41: note = nucleic acid sequence
  source 1..41: mol_type = other DNA
tttttgaacagtatttgttatacggctacactagaattttt

SEQ ID NO: 1152 - DNA, 31 bp, synthetic construct
  misc_feature 1..31: note = nucleic acid sequence
  source 1..31: mol_type = other DNA
ccatctggcgctatccggtaactatcttttt

SEQ ID NO: 1153 - DNA, 42 bp, synthetic construct
  misc_feature 1..42: note = nucleic acid sequence
  source 1..42: mol_type = other DNA
ccccagtgtcatctgcaccacacgaaccccccgttcattttt

SEQ ID NO: 1154 - DNA, 41 bp, synthetic construct
  misc_feature 1..41: note = nucleic acid sequence
  source 1..41: mol_type = other DNA
agtagttctggcggcccggcaactacaagacccgcgttttt

SEQ ID NO: 1155 - DNA, 33 bp, synthetic construct
  misc_feature 1..33: note = nucleic acid sequence
  source 1..33: mol_type = other DNA
tttttaaaggatcttcatagtttgcgcattttt

SEQ ID NO: 1156 - DNA, 28 bp, synthetic construct
  misc_feature 1..28: note = nucleic acid sequence
  source 1..28: mol_type = other DNA
tttttgaagccagttcacgctgtttttt

SEQ ID NO: 1157 - DNA, 26 bp, synthetic construct
  misc_feature 1..26: note = nucleic acid sequence
  source 1..26: mol_type = other DNA
accttcggtgctacagagttcttttt

SEQ ID NO: 1158 - DNA, 32 bp, synthetic construct
  misc_feature 1..32: note = nucleic acid sequence
  source 1..32: mol_type = other DNA
tagataagtcagggcgaaaaaaggtagagtaa

SEQ ID NO: 1159 - DNA, 55 bp, synthetic construct
  misc_feature 1..55: note = nucleic acid sequence
  source 1..55: mol_type = other DNA
ctacaagactccaactttctacgccatccagcttgtggcagatgaacttcagggt

SEQ ID NO: 1160 - DNA, 31 bp, synthetic construct
  misc_feature 1..31: note = nucleic acid sequence
  source 1..31: mol_type = other DNA
gaaccccttagctagcttaaggggatgtact

SEQ ID NO: 1161 - DNA, 52 bp, synthetic construct
  misc_feature 1..52: note = nucleic acid sequence
  source 1..52: mol_type = other DNA
actccctggaacaaaaactcagcagaagaccaggatggccagggcacgggca

SEQ ID NO: 1162 - DNA, 30 bp, synthetic construct
  misc_feature 1..30: note = nucleic acid sequence
  source 1..30: mol_type = other DNA
ctctgcgcaatgaccccgtaattatagcga

SEQ ID NO: 1163 - DNA, 51 bp, synthetic construct
  misc_feature 1..51: note = nucleic acid sequence
  source 1..51: mol_type = other DNA
gaggccggaccgagattatcaagcaataacctcgccacgccgtaggtcagg

SEQ ID NO: 1164 - DNA, 30 bp, synthetic construct
  misc_feature 1..30: note = nucleic acid sequence
  source 1..30: mol_type = other DNA
gcgaccaaaacgcggaactccataagtagg

SEQ ID NO: 1165 - DNA, 54 bp, synthetic construct
  misc_feature 1..54: note = nucleic acid sequence
  source 1..54: mol_type = other DNA
cgggctttcggcaaaattaaattatgacccacgacacctcatgtggtcggggta

SEQ ID NO: 1166 - DNA, 31 bp, synthetic construct
  misc_feature 1..31: note = nucleic acid sequence
  source 1..31: mol_type = other DNA
gcccgggcagccaggcgggccatgggcataa

SEQ ID NO: 1167 - DNA, 55 bp, synthetic construct
  misc_feature 1..55: note = nucleic acid sequence
  source 1..55: mol_type = other DNA
gcgagcgctcagctcaaaagtatacatctggcgtcagtaagcatggcggacttga

SEQ ID NO: 1168 - DNA, 32 bp, synthetic construct
  misc_feature 1..32: note = nucleic acid sequence
  source 1..32: mol_type = other DNA
gcagcctagacgtcaatgggcgggattgacgt

SEQ ID NO: 1169 - DNA, 55 bp, synthetic construct
  misc_feature 1..55: note = nucleic acid sequence
  source 1..55: mol_type = other DNA
aaggccagttgttaaattaccaatgtgtagatcgcaagagaagatggtgcgctcc

SEQ ID NO: 1170 - DNA, 31 bp, synthetic construct
  misc_feature 1..31: note = nucleic acid sequence
  source 1..31: mol_type = other DNA
caaaaggtggcgttactatgggatgatacac

SEQ ID NO: 1171 - DNA, 47 bp, synthetic construct
  misc_feature 1..47: note = nucleic acid sequence
  source 1..47: mol_type = other DNA
ctagagcatggctacgagtgtgagtcaaaccgctatccacgcccatt

SEQ ID NO: 1172 - DNA, 31 bp, synthetic construct
  misc_feature 1..31: note = nucleic acid sequence
  source 1..31: mol_type = other DNA
gatcttcgcgggttaatcattaattcggtgt

SEQ ID NO: 1173 - DNA, 55 bp, synthetic construct
  misc_feature 1..55: note = nucleic acid sequence
  source 1..55: mol_type = other DNA
cgaattcctttgatctgtcaaaggcagcatcttatcgggacccccttgctgtcct

SEQ ID NO: 1174 - DNA, 32 bp, synthetic construct
  misc_feature 1..32: note = nucleic acid sequence
  source 1..32: mol_type = other DNA
ttaataacagtgatggagttggcctttctcat

SEQ ID NO: 1175 - DNA, 55 bp, synthetic construct
  misc_feature 1..55: note = nucleic acid sequence
  source 1..55: mol_type = other DNA
gattactatggaacgagagtccacgtgagcaatatctacgcagaatagaatgaca

SEQ ID NO: 1176 - DNA, 31 bp, synthetic construct
  misc_feature 1..31: note = nucleic acid sequence
  source 1..31: mol_type = other DNA
tatgaactgctcgctcgctcacttccgcctt

SEQ ID NO: 1177 - DNA, 55 bp, synthetic construct
  misc_feature 1..55: note = nucleic acid sequence
  source 1..55: mol_type = other DNA
atatgggctcatgagatagggttgaaaaagggttgtagttgatgcaatttcctca

SEQ ID NO: 1178 - DNA, 30 bp, synthetic construct
  misc_feature 1..30: note = nucleic acid sequence
  source 1..30: mol_type = other DNA
agttatgtaggtcgcccgacgccgttccga

SEQ ID NO: 1179 - DNA, 52 bp, synthetic construct
  misc_feature 1..52: note = nucleic acid sequence
  source 1..52: mol_type = other DNA
ttaccgtagatcctttcccttagaatactcggagtggcagtgggagtggcac

SEQ ID NO: 1180 - DNA, 30 bp, synthetic construct
  misc_feature 1..30: note = nucleic acid sequence
  source 1..30: mol_type = other DNA
gggcggtcggcctcagtgagcgatccccct

SEQ ID NO: 1181 - DNA, 52 bp, synthetic construct
  misc_feature 1..52: note = nucleic acid sequence
  source 1..52: mol_type = other DNA
ggtcgtttcaatctttttttattgaagcaggcctcaaaggcacgggggaggg

SEQ ID NO: 1182 - DNA, 31 bp, synthetic construct
  misc_feature 1..31: note = nucleic acid sequence
  source 1..31: mol_type = other DNA
tcattattattaagggtgagcaaacccgaca

SEQ ID NO: 1183 - DNA, 54 bp, synthetic construct
  misc_feature 1..54: note = nucleic acid sequence
  source 1..54: mol_type = other DNA
acatacgtctgacagattcgcgtagcggatagcccgggctggcaactagaaggc

SEQ ID NO: 1184 - DNA, 23 bp, synthetic construct
  misc_feature 1..23: note = nucleic acid sequence
  source 1..23: mol_type = other DNA
tccctatccaggaaccgtaaaaa

SEQ ID NO: 1185 - DNA, 48 bp, synthetic construct
  misc_feature 1..48: note = nucleic acid sequence
  source 1..48: mol_type = other DNA
cattgacgtcaatgggacgctgaatctattaagttgttgctgttgaga

SEQ ID NO: 1186 - DNA, 48 bp, synthetic construct
  misc_feature 1..48: note = nucleic acid sequence
  source 1..48: mol_type = other DNA
tcccgttgattttggtccagctcgtggtcctgcacgctcgtcggggcg

SEQ ID NO: 1187 - DNA, 47 bp, synthetic construct
  misc_feature 1..47: note = nucleic acid sequence
  source 1..47: mol_type = other DNA
tggggcggagttgttagaacagctaccagccactccggttttaaaag

SEQ ID NO: 1188 - DNA, 45 bp, synthetic construct
  misc_feature 1..45: note = nucleic acid sequence
  source 1..45: mol_type = other DNA
ccgtacacgcctaccgccgcctggctcacctgatccctacgggat

SEQ ID NO: 1189 - DNA, 45 bp, synthetic construct
  misc_feature 1..45: note = nucleic acid sequence
  source 1..45: mol_type = other DNA
ctaaaccagctctgcagtggatcccagtgagctccttcggcgacc

SEQ ID NO: 1190 - DNA, 45 bp, synthetic construct
  misc_feature 1..45: note = nucleic acid sequence
  source 1..45: mol_type = other DNA
acgaccaacttctgctcagaaaaactacgagtaagttgtcaacca

SEQ ID NO: 1191 - DNA, 46 bp, synthetic construct
  misc_feature 1..46: note = nucleic acid sequence
  source 1..46: mol_type = other DNA
gtaaccttgatacttcaagcccaccatagtttatggcagcgtaaga

SEQ ID NO: 1192 - DNA, 38 bp, synthetic construct
  misc_feature 1..38: note = nucleic acid sequence
  source 1..38: mol_type = other DNA
actcgccctcgccctcgccggacgtggagagaagatcc

SEQ ID NO: 1193 - DNA, 30 bp, synthetic construct
  misc_feature 1..30: note = nucleic acid sequence
  source 1..30: mol_type = other DNA
cgtttacgtcgccgtgccaaaaacgctcag

SEQ ID NO: 1194 - DNA, 31 bp, synthetic construct
  misc_feature 1..31: note = nucleic acid sequence
  source 1..31: mol_type = other DNA
gggcaccaccccggtcgacatttgattttgg

SEQ ID NO: 1195 - DNA, 32 bp, synthetic construct
  misc_feature 1..32: note = nucleic acid sequence
  source 1..32: mol_type = other DNA
cttgctcaccatggcggcccatttttcaccta

SEQ ID NO: 1196 - DNA, 32 bp, synthetic construct
  misc_feature 1..32: note = nucleic acid sequence
  source 1..32: mol_type = other DNA
gtggagagaaaggcaattatataggttttaaa

SEQ ID NO: 1197 - DNA, 31 bp, synthetic construct
  misc_feature 1..31: note = nucleic acid sequence
  source 1..31: mol_type = other DNA
gaccaataggtgcctaaggatctgaacttgg

SEQ ID NO: 1198 - DNA, 30 bp, synthetic construct
  misc_feature 1..30: note = nucleic acid sequence
  source 1..30: mol_type = other DNA
tcttctctgtctcgaacctgcccagtgagg

SEQ ID NO: 1199 - DNA, 45 bp, synthetic construct
  misc_feature 1..45: note = nucleic acid sequence
  source 1..45: mol_type = other DNA
ctggtagtttgtcgggcagcagcaagcgaatccagttccaatcct

SEQ ID NO: 1200 - DNA, 46 bp, synthetic construct
  misc_feature 1..46: note = nucleic acid sequence
  source 1..46: mol_type = other DNA
tcctcgatgctcagggcggactggggtggcaaaaactcccaccccc

SEQ ID NO: 1201 - DNA, 48 bp, synthetic construct
  misc_feature 1..48: note = nucleic acid sequence
  source 1..48: mol_type = other DNA
ccttgatgccatgtgatcgcgcttgtcagcaatgctcatcgacaatgc

SEQ ID NO: 1202 - DNA, 48 bp, synthetic construct
  misc_feature 1..48: note = nucleic acid sequence
  source 1..48: mol_type = other DNA
gatatagaatcccggcggcggtcatgcctgacaataccgcggaaagga

SEQ ID NO: 1203 - DNA, 46 bp, synthetic construct
  misc_feature 1..46: note = nucleic acid sequence
  source 1..46: mol_type = other DNA
tccagctttacttgtacagctcggagacagcgagttgctgtcaagg

SEQ ID NO: 1204 - DNA, 45 bp, synthetic construct
  misc_feature 1..45: note = nucleic acid sequence
  source 1..45: mol_type = other DNA
ccttgaataatccagaggttgagaaaatgaagtcattccagatgg

SEQ ID NO: 1205 - DNA, 46 bp, synthetic construct
  misc_feature 1..46: note = nucleic acid sequence
  source 1..46: mol_type = other DNA
gttcaccaagaataccagtcaatgatacaatgcttttcaggcagat

SEQ ID NO: 1206 - DNA, 39 bp, synthetic construct
  misc_feature 1..39: note = nucleic acid sequence
  source 1..39: mol_type = other DNA
ggtagtggggtcggcgagctgcacgctgccggcttgccg

SEQ ID NO: 1207 - DNA, 39 bp, synthetic construct
  misc_feature 1..39: note = nucleic acid sequence
  source 1..39: mol_type = other DNA
gggtctttgttgtggcggatcttgaagttcagtggtcac

SEQ ID NO: 1208 - DNA, 38 bp, synthetic construct
  misc_feature 1..38: note = nucleic acid sequence
  source 1..38: mol_type = other DNA
agcaggaccgttcttctgcttgtcggccatgcggctga

SEQ ID NO: 1209 - DNA, 38 bp, synthetic construct
  misc_feature 1..38: note = nucleic acid sequence
  source 1..38: mol_type = other DNA
gagagtgcgttgtggctgttgtagttgtacagaagtcg

SEQ ID NO: 1210 - DNA, 39 bp, synthetic construct
  misc_feature 1..39: note = nucleic acid sequence
  source 1..39: mol_type = other DNA
aagcttatgtgccccaggatgttgccgtccttggacgta

SEQ ID NO: 1211 - DNA, 39 bp, synthetic construct
  misc_feature 1..39: note = nucleic acid sequence
  source 1..39: mol_type = other DNA
aaattttggtcgatgcccttcagctcgatgcgccgtcgt

SEQ ID NO: 1212 - DNA, 38 bp, synthetic construct
  misc_feature 1..38: note = nucleic acid sequence
  source 1..38: mol_type = other DNA
agtcccgggcggcgatgagttccgccgtggctgtcttc

SEQ ID NO: 1213 - DNA, 39 bp, synthetic construct
  misc_feature 1..39: note = nucleic acid sequence
  source 1..39: mol_type = other DNA
atgccccaccgagcccctgtccagcagcggggccccacc

SEQ ID NO: 1214 - DNA, 40 bp, synthetic construct
  misc_feature 1..40: note = nucleic acid sequence
  source 1..40: mol_type = other DNA
acacagtgacaacaccacggaattgtcagtgccctactca

SEQ ID NO: 1215 - DNA, 39 bp, synthetic construct
  misc_feature 1..39: note = nucleic acid sequence
  source 1..39: mol_type = other DNA
aacgggccgcagccaaggaaaggacgatgatttttatta

SEQ ID NO: 1216 - DNA, 39 bp, synthetic construct
  misc_feature 1..39: note = nucleic acid sequence
  source 1..39: mol_type = other DNA
aaccaggaccgcgcagaatccaggtggcaaccttccagg

SEQ ID NO: 1217 - DNA, 38 bp, synthetic construct
  misc_feature 1..38: note = nucleic acid sequence
  source 1..38: mol_type = other DNA
aagccatgagggccgaagggacgtagcagagcaaacaa

SEQ ID NO: 1218 - DNA, 37 bp, synthetic construct
  misc_feature 1..37: note = nucleic acid sequence
  source 1..37: mol_type = other DNA
aggcattgcaggccgcgggaaggaaggtccacagtcg

SEQ ID NO: 1219 - DNA, 46 bp, synthetic construct
  misc_feature 1..46: note = nucleic acid sequence
  source 1..46: mol_type = other DNA
caaggcagaaaggagctgacaggtgtgctcaacaggcatgtggtgc

SEQ ID NO: 1220 - DNA, 44 bp, synthetic construct
  misc_feature 1..44: note = nucleic acid sequence
  source 1..44: mol_type = other DNA
ccaacagaccagtgggggttgcctcgttggtatggctgagggtg

SEQ ID NO: 1221 - DNA, 46 bp, synthetic construct
  misc_feature 1..46: note = nucleic acid sequence
  source 1..46: mol_type = other DNA
ttccccgcacaccacgccacgtcgaactccatcaaggcagcactgc

SEQ ID NO: 1222 - DNA, 47 bp, synthetic construct
  misc_feature 1..47: note = nucleic acid sequence
  source 1..47: mol_type = other DNA
acaggcgaacaactcctcataaatccatgcctgcaaaaatgctgctt

SEQ ID NO: 1223 - DNA, 47 bp, synthetic construct
  misc_feature 1..47: note = nucleic acid sequence
  source 1..47: mol_type = other DNA
aggacgtctttatacaaggaggattggatcccgatcgttgccttcgg

SEQ ID NO: 1224 - DNA, 47 bp, synthetic construct
  misc_feature 1..47: note = nucleic acid sequence
  source 1..47: mol_type = other DNA
gctggattacgggaagcaatagcatctttcacgttatcaccttgaag

SEQ ID NO: 1225 - DNA, 24 bp, synthetic construct
  misc_feature 1..24: note = nucleic acid sequence
  source 1..24: mol_type = other DNA
gagtccccgattcgtgcacccaac

SEQ ID NO: 1226 - DNA, 36 bp, synthetic construct
  misc_feature 1..36: note = nucleic acid sequence
  source 1..36: mol_type = other DNA
attcgcccttaactcctacgtgccgtctatagcatg

SEQ ID NO: 1227 - DNA, 29 bp, synthetic construct
  misc_feature 1..29: note = nucleic acid sequence
  source 1..29: mol_type = other DNA
tagccatgctctaggtggggtcaacgtgg

SEQ ID NO: 1228 - DNA, 32 bp, synthetic construct
  misc_feature 1..32: note = nucleic acid sequence
  source 1..32: mol_type = other DNA
aatgattaacccgccaggaacccttccagttt

SEQ ID NO: 1229 - DNA, 32 bp, synthetic construct
  misc_feature 1..32: note = nucleic acid sequence
  source 1..32: mol_type = other DNA
ccaactccatcactagttgacgggaagaatag

SEQ ID NO: 1230 - DNA, 32 bp, synthetic construct
  misc_feature 1..32: note = nucleic acid sequence
  source 1..32: mol_type = other DNA
gtgagcgagcgagcgcaaggaagggccgaaat

SEQ ID NO: 1231 - DNA, 31 bp, synthetic construct
  misc_feature 1..31: note = nucleic acid sequence
  source 1..31: mol_type = other DNA
cgtcgggcgacctttctagggcgttgttaaa

SEQ ID NO: 1232 - DNA, 31 bp, synthetic construct
  misc_feature 1..31: note = nucleic acid sequence
  source 1..31: mol_type = other DNA
gctcactgaggccgcgcgcgtaattaatatt

SEQ ID NO: 1233 - DNA, 47 bp, synthetic construct
  misc_feature 1..47: note = nucleic acid sequence
  source 1..47: mol_type = other DNA
ccctaatcaagtttttaagatccttttactttcttaccgccattgct

SEQ ID NO: 1234 - DNA, 45 bp, synthetic construct
  misc_feature 1..45: note = nucleic acid sequence
  source 1..45: mol_type = other DNA
gtaaagcactaaatctgctactaaacaggaaacgttcttcgtttg

SEQ ID NO: 1235 - DNA, 46 bp, synthetic construct
  misc_feature 1..46: note = nucleic acid sequence
  source 1..46: mol_type = other DNA
cccccgatttagagcgggttccaataagggagcagaactcccaacg

SEQ ID NO: 1236 - DNA, 45 bp, synthetic construct
  misc_feature 1..45: note = nucleic acid sequence
  source 1..45: mol_type = other DNA
gcgaacgtggcgagagcagagagatactctgcgtcaaccatgttg

SEQ ID NO: 1237 - DNA, 45 bp, synthetic construct
  misc_feature 1..45: note = nucleic acid sequence
  source 1..45: mol_type = other DNA
cgaaaggagcgggcgggtcgccctttatcagtgtatgcggtcctc

SEQ ID NO: 1238 - DNA, 48 bp, synthetic construct
  misc_feature 1..48: note = nucleic acid sequence
  source 1..48: mol_type = other DNA
gtgtagcggtcacgctccgggcaaacatatttgtgagtacgccgcagt

SEQ ID NO: 1239 - DNA, 61 bp, synthetic construct
  misc_feature 1..61: note = nucleic acid sequence
  source 1..61: mol_type = other DNA
tcaaggatcaccagcgtccgcctgggtctgcaaactccgccaaaaccgcatcaccatggta

SEQ ID NO: 1240 - DNA, 61 bp, synthetic construct
  misc_feature 1..61: note = nucleic acid sequence
  source 1..61: mol_type = other DNA
attggaaaggcaaaggccgagccgttaaggtggaaagtgactaatacgtagatgtactgcc

SEQ ID NO: 1241 - DNA, 60 bp, synthetic construct
  misc_feature 1..60: note = nucleic acid sequence
  source 1..60: mol_type = other DNA
gccacatcgacacgatttatcaaaaggatcgcgtcaaaaagtcccataaggtcatgtact

SEQ ID NO: 1242 - DNA, 63 bp, synthetic construct
  misc_feature 1..63: note = nucleic acid sequence
  source 1..63: mol_type = other DNA
cttgcccgtcctttttataccgcgaaaatgaaacctcccatgccaggcgggccatttaccgtc

SEQ ID NO: 1243 - DNA, 63 bp, synthetic construct
  misc_feature 1..63: note = nucleic acid sequence
  source 1..63: mol_type = other DNA
tgagaatagggttattgggcttactatgagtaacggttcacaatagggggcgtacttggcata

SEQ ID NO: 1244 - DNA, 63 bp, synthetic construct
  misc_feature 1..63: note = nucleic acid sequence
  source 1..63: mol_type = other DNA
tgtgactggaatgtattccccgtcgcttaatcagtgcctcttgatgtactgccaagtgggcag

SEQ ID NO: 1245 - DNA, 62 bp, synthetic construct
  misc_feature 1..62: note = nucleic acid sequence
  source 1..62: mol_type = other DNA
tgcgcaacttgttgcctgatcttgcgaaaaaaaccatcaaggtcgttcgctccaagctgggc

SEQ ID NO: 1246 - DNA, 62 bp, synthetic construct
  misc_feature 1..62: note = nucleic acid sequence
  source 1..62: mol_type = other DNA
cgtggtgtcaactttatttctggtattaaaggaggtgccagctcacgctgtaggtatctcag

SEQ ID NO: 1247 - DNA, 63 bp, synthetic construct
  misc_feature 1..63: note = nucleic acid sequence
  source 1..63: mol_type = other DNA
tcattcaggccggaagatgccgcaagtgttgtaaagggagtctcccttcgggaagcgtggcgc

SEQ ID NO: 1248 - DNA, 63 bp, synthetic construct
  misc_feature 1..63: note = nucleic acid sequence
  source 1..63: mol_type = other DNA
gagttacaggctccaggaaatgtttaaatcaagaaagccgccctgccgcttaccggatacctg

SEQ ID NO: 1249 - DNA, 63 bp, synthetic construct
  misc_feature 1..63: note = nucleic acid sequence
  source 1..63: mol_type = other DNA
agcggttctgcaatgcaatattaaccaataggaagaaagggaagctccctcgtgcgctctcct

SEQ ID NO: 1250 - DNA, 59 bp, synthetic construct
  misc_feature 1..59: note = nucleic acid sequence
  source 1..59: mol_type = other DNA
gtcagaatacgggagtctcatgtaaatttctggcaaggactataaagataccaggcgtt

SEQ ID NO: 1251 - DNA, 60 bp, synthetic construct
  misc_feature 1..60: note = nucleic acid sequence
  source 1..60: mol_type = other DNA
ctcatggtgcctgacttagaaaagtaagcgccaccacacgctcaagtcagaggtggcgaa

SEQ ID NO: 1252 - DNA, 34 bp, synthetic construct
  misc_feature 1..34: note = nucleic acid sequence
  source 1..34: mol_type = other DNA
aaaaatcgacccgccgcgcttaatgttaattttt

SEQ ID NO: 1253 - DNA, 39 bp, synthetic construct
  misc_feature 1..39: note = nucleic acid sequence
  source 1..39: mol_type = other DNA
tttttggctccgcccccctgacgagcatcacggccgcgt

SEQ ID NO: 1254 - DNA, 43 bp, synthetic construct
  misc_feature 1..43: note = nucleic acid sequence
  source 1..43: mol_type = other DNA
tttttcccgttcagcccgactgtgtgcaagttaccatggccca

SEQ ID NO: 1255 - DNA, 64 bp, synthetic construct
  misc_feature 1..64: note = nucleic acid sequence
  source 1..64: mol_type = other DNA
atggaaagcacctatccctaaattataaacagctcgctcctcgaagacgcggaagaggcttttt

SEQ ID NO: 1256 - DNA, 29 bp, synthetic construct
  misc_feature 1..29: note = nucleic acid sequence
  source 1..29: mol_type = other DNA
tttttccacccattgacgtcatttaccgt

SEQ ID NO: 1257 - DNA, 28 bp, synthetic construct
  misc_feature 1..28: note = nucleic acid sequence
  source 1..28: mol_type = other DNA
tttttgtaactatcgtcttgcgctgcgc

SEQ ID NO: 1258 - DNA, 28 bp, synthetic construct
  misc_feature 1..28: note = nucleic acid sequence
  source 1..28: mol_type = other DNA
tttttaaacctgtcttaaatactttttt

SEQ ID NO: 1259 - DNA, 42 bp, synthetic construct
  misc_feature 1..42: note = nucleic acid sequence
  source 1..42: mol_type = other DNA
tttttacgacttatcgccgtatttttttgtttgcaagttttt

SEQ ID NO: 1260 - DNA, 30 bp, synthetic construct
  misc_feature 1..30: note = nucleic acid sequence
  source 1..30: mol_type = other DNA
ttttttcacctcggctggtctccttttttt

SEQ ID NO: 1261 - DNA, 48 bp, synthetic construct
  misc_feature 1..48: note = nucleic acid sequence
  source 1..48: mol_type = other DNA
ttttttaacaggattagcagagcgccgatgggggtgttctgcagcttg

SEQ ID NO: 1262 - DNA, 29 bp, synthetic construct
  misc_feature 1..29: note = nucleic acid sequence
  source 1..29: mol_type = other DNA
tttttgtaaaaggagcaaattctcttttt

SEQ ID NO: 1263 - DNA, 40 bp, synthetic construct
  misc_feature 1..40: note = nucleic acid sequence
  source 1..40: mol_type = other DNA
ttttttgctacagagttcttgagggagggggaacggggcc

SEQ ID NO: 1264 - DNA, 44 bp, synthetic construct
  misc_feature 1..44: note = nucleic acid sequence
  source 1..44: mol_type = other DNA
tttttcgcagagccggcaaaagcagcgtatccacatagcttttt

SEQ ID NO: 1265 - DNA, 62 bp, synthetic construct
  misc_feature 1..62: note = nucleic acid sequence
  source 1..62: mol_type = other DNA
tttttcactagaaggacagtatgcctgctataataagtggtggcctaactacggctattttt

SEQ ID NO: 1266 - DNA, 33 bp, synthetic construct
  misc_feature 1..33: note = nucleic acid sequence
  source 1..33: mol_type = other DNA
tttttttaaggctgcgcaataggggatgccatc

SEQ ID NO: 1267 - DNA, 28 bp, synthetic construct
  misc_feature 1..28: note = nucleic acid sequence
  source 1..28: mol_type = other DNA
tttttctgctgaagcccgaacccttttt

SEQ ID NO: 1268 - DNA, 26 bp, synthetic construct
  misc_feature 1..26: note = nucleic acid sequence
  source 1..26: mol_type = other DNA
aagtgccatcagcgatctgtcttttt

SEQ ID NO: 1269 - DNA, 38 bp, synthetic construct
  misc_feature 1..38: note = nucleic acid sequence
  source 1..38: mol_type = other DNA
ttttttttccccgaatgctggcgtttttccatattttt

SEQ ID NO: 1270 - DNA, 41 bp, synthetic construct
  misc_feature 1..41: note = nucleic acid sequence
  source 1..41: mol_type = other DNA
tttttttggtagctcttagcatttggtatctgcgctttttt

SEQ ID NO: 1271 - DNA, 47 bp, synthetic construct
  misc_feature 1..47: note = nucleic acid sequence
  source 1..47: mol_type = other DNA
cgatgtaacccacccgcgccagttgtcgaggtatgtaggcggttttt

SEQ ID NO: 1272 - DNA, 29 bp, synthetic construct
  misc_feature 1..29: note = nucleic acid sequence
  source 1..29: mol_type = other DNA
tttttttactgtcttccgcgcacattttt

SEQ ID NO: 1273 - DNA, 41 bp, synthetic construct
  misc_feature 1..41: note = nucleic acid sequence
  source 1..41: mol_type = other DNA
ttttttggtagcggtgggttgcaaacaaaccaccgcttttt

SEQ ID NO: 1274 - DNA, 40 bp, synthetic construct
  misc_feature 1..40: note = nucleic acid sequence
  source 1..40: mol_type = other DNA
aatagttccgtaggtggcatggcagcagccactggttttt

SEQ ID NO: 1275 - DNA, 40 bp, synthetic construct
  misc_feature 1..40: note = nucleic acid sequence
  source 1..40: mol_type = other DNA
cactgcatacatagttagggtgtcgccctcgaactttttt

SEQ ID NO: 1276 - DNA, 47 bp, synthetic construct
  misc_feature 1..47: note = nucleic acid sequence
  source 1..47: mol_type = other DNA
gggaagcatctcaacttggaaatccccccaacccggtaagacttttt

SEQ ID NO: 1277 - DNA, 41 bp, synthetic construct
  misc_feature 1..41: note = nucleic acid sequence
  source 1..41: mol_type = other DNA
ttttttatttcgttcatgtttctatgcgggtcttgtagttg

SEQ ID NO: 1278 - DNA, 28 bp, synthetic construct
  misc_feature 1..28: note = nucleic acid sequence
  source 1..28: mol_type = other DNA
tttttcagcagattacttatccgttttt

SEQ ID NO: 1279 - DNA, 26 bp, synthetic construct
  misc_feature 1..26: note = nucleic acid sequence
  source 1..26: mol_type = other DNA
cgcgcagattcggaaaaagagttttt

SEQ ID NO: 1280 - DNA, 30 bp, synthetic construct
  misc_feature 1..30: note = nucleic acid sequence
  source 1..30: mol_type = other DNA
caatggaagaaagtcccataaggctgtctt

SEQ ID NO: 1281 - DNA, 31 bp, synthetic construct
  misc_feature 1..31: note = nucleic acid sequence
  source 1..31: mol_type = other DNA
gaacatacatgactaatacgtagagtgcctc

SEQ ID NO: 1282 - DNA, 31 bp, synthetic construct
  misc_feature 1..31: note = nucleic acid sequence
  source 1..31: mol_type = other DNA
ggggtcgtctgccaaaaccgcatacggttca

SEQ ID NO: 1283 - DNA, 30 bp, synthetic construct
  misc_feature 1..30: note = nucleic acid sequence
  source 1..30: mol_type = other DNA
tttaccgagtcaaaccgctatcacctccca

SEQ ID NO: 1284 - DNA, 31 bp, synthetic construct
  misc_feature 1..31: note = nucleic acid sequence
  source 1..31: mol_type = other DNA
tatatggtcaatggggtggagacgcgtcaat

SEQ ID NO: 1285 - DNA, 55 bp, synthetic construct
  misc_feature 1..55: note = nucleic acid sequence
  source 1..55: mol_type = other DNA
gtcaatagggggcgtagctcagaaacgcaagagtcttctctgtctcgtttaccgt

SEQ ID NO: 1286 - DNA, 30 bp, synthetic construct
  misc_feature 1..30: note = nucleic acid sequence
  source 1..30: mol_type = other DNA
tgggcatgtaaatactccacccaggtggcg

SEQ ID NO: 1287 - DNA, 31 bp, synthetic construct
  misc_feature 1..31: note = nucleic acid sequence
  source 1..31: mol_type = other DNA
ccaagtagagtccctattggcgtcgagcatc

SEQ ID NO: 1288 - DNA, 31 bp, synthetic construct
  misc_feature 1..31: note = nucleic acid sequence
  source 1..31: mol_type = other DNA
taatagcggtcattattgacgtctggcgttt

SEQ ID NO: 1289 - DNA, 31 bp, synthetic construct
  misc_feature 1..31: note = nucleic acid sequence
  source 1..31: mol_type = other DNA
ttgatgtatgggcggtcagccagaaggccag

SEQ ID NO: 1290 - DNA, 32 bp, synthetic construct
  misc_feature 1..32: note = nucleic acid sequence
  source 1..32: mol_type = other DNA
tccccgtgtaagttatgtaacgcgcataatgt

SEQ ID NO: 1291 - DNA, 30 bp, synthetic construct
  misc_feature 1..30: note = nucleic acid sequence
  source 1..30: mol_type = other DNA
acaagccgcaaagtggatgtcatgtcgccc

SEQ ID NO: 1292 - DNA, 40 bp, synthetic construct
  misc_feature 1..40: note = nucleic acid sequence
  source 1..40: mol_type = other DNA
ggcggccgcctggacacttgtagtctgactccgccggaag

SEQ ID NO: 1293 - DNA, 40 bp, synthetic construct
  misc_feature 1..40: note = nucleic acid sequence
  source 1..40: mol_type = other DNA
cggtgaacagctcctcgtgcgctccgatctgtcaacttta

SEQ ID NO: 1294 - DNA, 40 bp, synthetic construct
  misc_feature 1..40: note = nucleic acid sequence
  source 1..40: mol_type = other DNA
ccgtccagctcgaccacggacttgcaatgcttttgttgcc

SEQ ID NO: 1295 - DNA, 38 bp, synthetic construct
  misc_feature 1..38: note = nucleic acid sequence
  source 1..38: mol_type = other DNA
gacacgctgaacttggtcggggtatatatgccagttaa

SEQ ID NO: 1296 - DNA, 37 bp, synthetic construct
  misc_feature 1..37: note = nucleic acid sequence
  source 1..37: mol_type = other DNA
gccgtaggtggcatctaggtcattaaaaattgctaca

SEQ ID NO: 1297 - DNA, 37 bp, synthetic construct
  misc_feature 1..37: note = nucleic acid sequence
  source 1..37: mol_type = other DNA
gccccagcacctcggcgcgggtcctgtggtggtagct

SEQ ID NO: 1298 - DNA, 37 bp, synthetic construct
  misc_feature 1..37: note = nucleic acid sequence
  source 1..37: mol_type = other DNA
ttgtggctccttgaagaagatggcccttggctggtag

SEQ ID NO: 1299 - DNA, 40 bp, synthetic construct
  misc_feature 1..40: note = nucleic acid sequence
  source 1..40: mol_type = other DNA
gttcttcttagccttcgggcatggggatgggcagcagatt

SEQ ID NO: 1300 - DNA, 39 bp, synthetic construct
  misc_feature 1..39: note = nucleic acid sequence
  source 1..39: mol_type = other DNA
tgtggcggcgtgctgcttcatgtgtggccgttagaagat

SEQ ID NO: 1301 - DNA, 39 bp, synthetic construct
  misc_feature 1..39: note = nucleic acid sequence
  source 1..39: mol_type = other DNA
tcggcgaggaagcactgcacgccggccctcgcgacgctc

SEQ ID NO: 1302 - DNA, 39 bp, synthetic construct
  misc_feature 1..39: note = nucleic acid sequence
  source 1..39: mol_type = other DNA
gtcgccgaacgagggtgggccagacttcagggggatttt

SEQ ID NO: 1303 - DNA, 31 bp, synthetic construct
  misc_feature 1..31: note = nucleic acid sequence
  source 1..31: mol_type = other DNA
aggagcaagcatgatacaaaggcggcagcag

SEQ ID NO: 1304 - DNA, 32 bp, synthetic construct
  misc_feature 1..32: note = nucleic acid sequence
  source 1..32: mol_type = other DNA
tctttcacaggagaaaatgaaagcgattgagg

SEQ ID NO: 1305 - DNA, 60 bp, synthetic construct
  misc_feature 1..60: note = nucleic acid sequence
  source 1..60: mol_type = other DNA
gaagcaatacatagttaagaataccagtcaacagcttgtccagccaccgtcgtatacggg

SEQ ID NO: 1306 - DNA, 60 bp, synthetic construct
  misc_feature 1..60: note = nucleic acid sequence
  source 1..60: mol_type = other DNA
tacaaggaaattttgtaatccagaggttgatatagacgggtcctgctatttcgctttaaa

SEQ ID NO: 1307 - DNA, 32 bp, synthetic construct
  misc_feature 1..32: note = nucleic acid sequence
  source 1..32: mol_type = other DNA
taaagagacagcaacccgtcccgcgcagcact

SEQ ID NO: 1308 - DNA, 62 bp, synthetic construct
  misc_feature 1..62: note = nucleic acid sequence
  source 1..62: mol_type = other DNA
ctcctcaaagcttattacttgtacagctcgttgatgcctctattaaaatcagtgcttcgggg

SEQ ID NO: 1309 - DNA, 30 bp, synthetic construct
  misc_feature 1..30: note = nucleic acid sequence
  source 1..30: mol_type = other DNA
cgttgcctgacaacggcgagcagttggccg

SEQ ID NO: 1310 - DNA, 63 bp, synthetic construct
  misc_feature 1..63: note = nucleic acid sequence
  source 1..63: mol_type = other DNA
ccacgccagagagtgatcccggcggcggtcactcgatgtgtagttcgagtaaactgctgttga

SEQ ID NO: 1311 - DNA, 29 bp, synthetic construct
  misc_feature 1..29: note = nucleic acid sequence
  source 1..29: mol_type = other DNA
tgcgtcagcaaacacccgacaacttcggt

SEQ ID NO: 1312 - DNA, 63 bp, synthetic construct
  misc_feature 1..63: note = nucleic acid sequence
  source 1..63: mol_type = other DNA
gtgggggtagcaggaccatgtgatcgcgcttggtagtggtgttgccatgaagtttcgtgcacc

SEQ ID NO: 1313 - DNA, 30 bp, synthetic construct
  misc_feature 1..30: note = nucleic acid sequence
  source 1..30: mol_type = other DNA
aggtggtggcaatgcacagccgacccccat

SEQ ID NO: 1314 - DNA, 62 bp, synthetic construct
  misc_feature 1..62: note = nucleic acid sequence
  source 1..62: mol_type = other DNA
gagctgacggtctttgctcagggcggactggcggggcccgctcgtcgatcttcactttcacc

SEQ ID NO: 1315 - DNA, 55 bp, synthetic construct
  misc_feature 1..55: note = nucleic acid sequence
  source 1..55: mol_type = other DNA
gcaggcggggttcccaagcatgccggtcgaggtgccgtaacactacgcgcaaaaa

SEQ ID NO: 1316 - DNA, 38 bp, synthetic construct
  misc_feature 1..38: note = nucleic acid sequence
  source 1..38: mol_type = other DNA
acagtcgaaaggaaggtccgctgcatacgggcaataaa

SEQ ID NO: 1317 - DNA, 40 bp, synthetic construct
  misc_feature 1..40: note = nucleic acid sequence
  source 1..40: mol_type = other DNA
gcaaacaaggacgtagcagaaggaaggatttagcagaagt

SEQ ID NO: 1318 - DNA, 39 bp, synthetic construct
  misc_feature 1..39: note = nucleic acid sequence
  source 1..39: mol_type = other DNA
cttccaggccaggtggcaacacagggccacaacatccag

SEQ ID NO: 1319 - DNA, 39 bp, synthetic construct
  misc_feature 1..39: note = nucleic acid sequence
  source 1..39: mol_type = other DNA
ttttattaaaggacgatgatttccagtgcacaagagtaa

SEQ ID NO: 1320 - DNA, 39 bp, synthetic construct
  misc_feature 1..39: note = nucleic acid sequence
  source 1..39: mol_type = other DNA
cctactcaaattgtcagtgcccacccaaccacgcaacgt

SEQ ID NO: 1321 - DNA, 38 bp, synthetic construct
  misc_feature 1..38: note = nucleic acid sequence
  source 1..38: mol_type = other DNA
ccccaccccagcagcgggcaagccggaaagtggtgtca

SEQ ID NO: 1322 - DNA, 37 bp, synthetic construct
  misc_feature 1..37: note = nucleic acid sequence
  source 1..37: mol_type = other DNA
ggagtggggcgctggcaagtgttataaatcaaaaata

SEQ ID NO: 1323 - DNA, 39 bp, synthetic construct
  misc_feature 1..39: note = nucleic acid sequence
  source 1..39: mol_type = other DNA
ttgtagttaagggaagaaagcgatgagtgttcatgagcg

SEQ ID NO: 1324 - DNA, 40 bp, synthetic construct
  misc_feature 1..40: note = nucleic acid sequence
  source 1..40: mol_type = other DNA
tatctacgcggggaaagccggcgaactattaaattattga

SEQ ID NO: 1325 - DNA, 40 bp, synthetic construct
  misc_feature 1..40: note = nucleic acid sequence
  source 1..40: mol_type = other DNA
tatcgggaccctaaagggagccccgggcgaaatgttgaat

SEQ ID NO: 1326 - DNA, 32 bp, synthetic construct
  misc_feature 1..32: note = nucleic acid sequence
  source 1..32: mol_type = other DNA
tcgctcgcgtagagaatagtgtattctggccc

SEQ ID NO: 1327 - DNA, 46 bp, synthetic construct
  misc_feature 1..46: note = nucleic acid sequence
  source 1..46: mol_type = other DNA
aatcagctcatttttgccgcgctctcttgccttctgtgatttatca

SEQ ID NO: 1328 - DNA, 46 bp, synthetic construct
  misc_feature 1..46: note = nucleic acid sequence
  source 1..46: mol_type = other DNA
atcggcaaaatccctagcggtcagcgccacactcttacggccgagc

SEQ ID NO: 1329 - DNA, 47 bp, synthetic construct
  misc_feature 1..47: note = nucleic acid sequence
  source 1..47: mol_type = other DNA
agaccgagatagggtaaggagcgtcattggatcactcattccgcctc

SEQ ID NO: 1330 - DNA, 46 bp, synthetic construct
  misc_feature 1..46: note = nucleic acid sequence
  source 1..46: mol_type = other DNA
ttggaacaagagtccacgtggcctcaaggacgttgtcagggaagct

SEQ ID NO: 1331 - DNA, 45 bp, synthetic construct
  misc_feature 1..45: note = nucleic acid sequence
  source 1..45: mol_type = other DNA
ggactccaacgtcaaacgatttatcgatgtaaaaagcgtagtttg

SEQ ID NO: 1332 - DNA, 46 bp, synthetic construct
  misc_feature 1..46: note = nucleic acid sequence
  source 1..46: mol_type = other DNA
tatcagggcgatggccagcactaacttcagcaggcgagtggcatcg

SEQ ID NO: 1333 - DNA, 55 bp, synthetic construct
  misc_feature 1..55: note = nucleic acid sequence
  source 1..55: mol_type = other DNA
ttttgttattggtatccagtgctgagtctcgatgcggttcaccaggggtaagacc

SEQ ID NO: 1334 - DNA, 31 bp, synthetic construct
  misc_feature 1..31: note = nucleic acid sequence
  source 1..31: mol_type = other DNA
ttccccgagtttaccaatgccaggcgggcca

SEQ ID NO: 1335 - DNA, 54 bp, synthetic construct
  misc_feature 1..54: note = nucleic acid sequence
  source 1..54: mol_type = other DNA
gcgcacataggccgaaaaacccgacaggactataaagatagtgggcaaaagtgc

SEQ ID NO: 1336 - DNA, 40 bp, synthetic construct
  misc_feature 1..40: note = nucleic acid sequence
  source 1..40: mol_type = other DNA
ggggttccataatacccgctgcgcgtgagcgagcgagcgc

SEQ ID NO: 1337 - DNA, 62 bp, synthetic construct
  misc_feature 1..62: note = nucleic acid sequence
  source 1..62: mol_type = other DNA
gtatttagaaaagaatacaaaaatcgacgctcaagtcagattgacgtaacaaataggcaaac

SEQ ID NO: 1338 - DNA, 40 bp, synthetic construct
  misc_feature 1..40: note = nucleic acid sequence
  source 1..40: mol_type = other DNA
atttgaatagtgctcaggcgctagccaactccatcactag

SEQ ID NO: 1339 - DNA, 62 bp, synthetic construct
  misc_feature 1..62: note = nucleic acid sequence
  source 1..62: mol_type = other DNA
tattgtctgttccagtttccataggctccgcccccctgatactatgggatacatttttttgt

SEQ ID NO: 1340 - DNA, 40 bp, synthetic construct
  misc_feature 1..40: note = nucleic acid sequence
  source 1..40: mol_type = other DNA
atcagggtcgaaaactgagaaaggaatgattaacccgcca

SEQ ID NO: 1341 - DNA, 61 bp, synthetic construct
  misc_feature 1..61: note = nucleic acid sequence
  source 1..61: mol_type = other DNA
ttttcaatagaacgtgaaccgtaaaaaggccgcgttgcaatgggcgagcatttgaaaaaaa

SEQ ID NO: 1342 - DNA, 38 bp, synthetic construct
  misc_feature 1..38: note = nucleic acid sequence
  source 1..38: mol_type = other DNA
tcttcctgatccagtgagcttgatagccatgctctagg

SEQ ID NO: 1343 - DNA, 62 bp, synthetic construct
  misc_feature 1..62: note = nucleic acid sequence
  source 1..62: mol_type = other DNA
cacggaaaaaccgtcaagggtgagcaaaaggccagcaagcgggccaactcataccttttcta

SEQ ID NO: 1344 - DNA, 37 bp, synthetic construct
  misc_feature 1..37: note = nucleic acid sequence
  source 1..37: mol_type = other DNA
agggcgacaactgatatcggaaattcgcccttaactc

SEQ ID NO: 1345 - DNA, 62 bp, synthetic construct
  misc_feature 1..62: note = nucleic acid sequence
  source 1..62: mol_type = other DNA
aaaatgctgaaccatggcgaattccgatcttcctagaggaactccaagggaatagaaaactc

SEQ ID NO: 1346 - DNA, 54 bp, synthetic construct
  misc_feature 1..54: note = nucleic acid sequence
  source 1..54: mol_type = other DNA
gtactcaaagcccgggattaaggctgcgcgcgttaaatcgttaatatatgatac

SEQ ID NO: 1347 - DNA, 38 bp, synthetic construct
  misc_feature 1..38: note = nucleic acid sequence
  source 1..38: mol_type = other DNA
catccgtaggcctcagtaaccaccacaccctaaccaat

SEQ ID NO: 1348 - DNA, 62 bp, synthetic construct
  misc_feature 1..62: note = nucleic acid sequence
  source 1..62: mol_type = other DNA
tgtcatgcgccgaagcagatggctggcaactagaaggcggtcgcccagatgcttcggcgtca

SEQ ID NO: 1349 - DNA, 61 bp, synthetic construct
  misc_feature 1..61: note = nucleic acid sequence
  source 1..61: mol_type = other DNA
ggttatggcagaatgtcaaggaaggcacgggggaggggcagagaggcataatttagcagaa

SEQ ID NO: 1350 - DNA, 60 bp, synthetic construct
  misc_feature 1..60: note = nucleic acid sequence
  source 1..60: mol_type = other DNA
gaagtaagccaaggaggaaaggacagtgggagtggcacgggttcccagtgttaaaacgtt

SEQ ID NO: 1351 - DNA, 61 bp, synthetic construct
  misc_feature 1..61: note = nucleic acid sequence
  source 1..61: mol_type = other DNA
gttagctccaccacgggacaatgcgatgcaatttcctcatgctactcctccgattcttacc

SEQ ID NO: 1352 - DNA, 63 bp, synthetic construct
  misc_feature 1..63: note = nucleic acid sequence
  source 1..63: mol_type = other DNA
tacatgatgcccctgtccaccccccagaatagaatgacaaagatcctgttgtgcaaacccact

SEQ ID NO: 1353 - DNA, 61 bp, synthetic construct
  misc_feature 1..61: note = nucleic acid sequence
  source 1..61: mol_type = other DNA
cttaccagcggcgacttgtaagttttgttagtttccccctggaagctccctctccttggca

SEQ ID NO: 1354 - DNA, 62 bp, synthetic construct
  misc_feature 1..62: note = nucleic acid sequence
  source 1..62: mol_type = other DNA
cgggaggggctccagactggtgagccgcgggggcagatctcgaagacgcggaagccgggcaa

SEQ ID NO: 1355 - DNA, 64 bp, synthetic construct
  misc_feature 1..64: note = nucleic acid sequence
  source 1..64: mol_type = other DNA
gtagataaaaaagagtagagaaagcagtttctattggtctccttaaactcatgtaccttgatcc

SEQ ID NO: 1356 - DNA, 32 bp, synthetic construct
  misc_feature 1..32: note = nucleic acid sequence
  source 1..32: mol_type = other DNA
atagttgctgccgtcgtgttgtagttgtactc

SEQ ID NO: 1357 - DNA, 61 bp, synthetic construct
  misc_feature 1..61: note = nucleic acid sequence
  source 1..61: mol_type = other DNA
ttcatccaaaccaccctcaccatgtaaccttgatacttacctgcccatgtactgcggtggt

SEQ ID NO: 1358 - DNA, 38 bp, synthetic construct
  misc_feature 1..38: note = nucleic acid sequence
  source 1..38: mol_type = other DNA
tatctcagctggacggcttgtcggccatgattggatcc

SEQ ID NO: 1359 - DNA, 60 bp, synthetic construct
  misc_feature 1..60: note = nucleic acid sequence
  source 1..60: mol_type = other DNA
aggcaccttgcaagcaccacccacgaccaacttctgcaggatctgcaccatggacgcgca

SEQ ID NO: 1360 - DNA, 37 bp, synthetic construct
  misc_feature 1..37: note = nucleic acid sequence
  source 1..37: mol_type = other DNA
cagttacaagaagtatcttgaagttcacctccatgcc

SEQ ID NO: 1361 - DNA, 62 bp, synthetic construct
  misc_feature 1..62: note = nucleic acid sequence
  source 1..62: mol_type = other DNA
tggtctgaggatctcatacgtcgctaaaccagctctgcttatatagcacgcccacctttgat

SEQ ID NO: 1362 - DNA, 38 bp, synthetic construct
  misc_feature 1..38: note = nucleic acid sequence
  source 1..38: mol_type = other DNA
tctaaagtagcggctctgcacgctgccgtccgaactcc

SEQ ID NO: 1363 - DNA, 62 bp, synthetic construct
  misc_feature 1..62: note = nucleic acid sequence
  source 1..62: mol_type = other DNA
taaatcaacggggtctcctcgccgccgtacacgcctaccgcccatttttggaaaagtggaac

SEQ ID NO: 1364 - DNA, 39 bp, synthetic construct
  misc_feature 1..39: note = nucleic acid sequence
  source 1..39: mol_type = other DNA
cttttaaagggtggtctgggggtgttctgctctcgttgg

SEQ ID NO: 1365 - DNA, 38 bp, synthetic construct
  misc_feature 1..38: note = nucleic acid sequence
  source 1..38: mol_type = other DNA
tgctgaagcattgacacttgatgtactgccaaccaggc

SEQ ID NO: 1366 - DNA, 46 bp, synthetic construct
  misc_feature 1..46: note = nucleic acid sequence
  source 1..46: mol_type = other DNA
ccagttaccacctaaacgagttgtaatgttacgtcgggcgaccttt

SEQ ID NO: 1367 - DNA, 39 bp, synthetic construct
  misc_feature 1..39: note = nucleic acid sequence
  source 1..39: mol_type = other DNA
cttcggactacgatatcgaacttgatgttgccgtcctcc

SEQ ID NO: 1368 - DNA, 41 bp, synthetic construct
  misc_feature 1..41: note = nucleic acid sequence
  source 1..41: mol_type = other DNA
ttttttattaataactagctacccgtaattgattacttttt

SEQ ID NO: 1369 - DNA, 44 bp, synthetic construct
  misc_feature 1..44: note = nucleic acid sequence
  source 1..44: mol_type = other DNA
tttttcgcttaccggatacctctgttccagcagccaaaattcgc

SEQ ID NO: 1370 - DNA, 47 bp, synthetic construct
  misc_feature 1..47: note = nucleic acid sequence
  source 1..47: mol_type = other DNA
cattgacggctatgaactaatgacgcttaagcaccctaatcattttt

SEQ ID NO: 1371 - DNA, 41 bp, synthetic construct
  misc_feature 1..41: note = nucleic acid sequence
  source 1..41: mol_type = other DNA
tttttattttggtgccaaaactggaaagtcccgttgttttt

SEQ ID NO: 1372 - DNA, 53 bp, synthetic construct
  misc_feature 1..53: note = nucleic acid sequence
  source 1..53: mol_type = other DNA
tttttttcgggaagcgtggcgtccgccgacagtatctggtaacaggatttttt

SEQ ID NO: 1373 - DNA, 54 bp, synthetic construct
  misc_feature 1..54: note = nucleic acid sequence
  source 1..54: mol_type = other DNA
gtcagcttggggcggagttgttacgacatttaaactccggtcatgagatttttt

SEQ ID NO: 1374 - DNA, 41 bp, synthetic construct
  misc_feature 1..41: note = nucleic acid sequence
  source 1..41: mol_type = other DNA
tttttcggtggtgcagatgaggcacgggcagcttgcttttt

SEQ ID NO: 1375 - DNA, 41 bp, synthetic construct
  misc_feature 1..41: note = nucleic acid sequence
  source 1..41: mol_type = other DNA
ttttttgtaggtatctccaatggcctaactacggctttttt

SEQ ID NO: 1376 - DNA, 43 bp, synthetic construct
  misc_feature 1..43: note = nucleic acid sequence
  source 1..43: mol_type = other DNA
tttttttgtcgggcagcagcagtgctcagggaaagcgaaagtc

SEQ ID NO: 1377 - DNA, 56 bp, synthetic construct
  misc_feature 1..56: note = nucleic acid sequence
  source 1..56: mol_type = other DNA
tttttgctccaagctgggctgtcgtatccacatagcgtaaattgaagtgctcaccg

SEQ ID NO: 1378 - DNA, 29 bp, synthetic construct
  misc_feature 1..29: note = nucleic acid sequence
  source 1..29: mol_type = other DNA
tttttcaatagggaggggtagtggttttt

SEQ ID NO: 1379 - DNA, 38 bp, synthetic construct
  misc_feature 1..38: note = nucleic acid sequence
  source 1..38: mol_type = other DNA
tttttgttcagcccgaccgctccgcagagccattaaag

SEQ ID NO: 1380 - DNA, 70 bp, synthetic construct
  misc_feature 1..70: note = nucleic acid sequence
  source 1..70: mol_type = other DNA
tttttttcccaatcctcccccttgctgtcctggagtccccacgatcaatcttttacctagatcacgttaa

SEQ ID NO: 1381 - DNA, 61 bp, synthetic construct
  misc_feature 1..61: note = nucleic acid sequence
  source 1..61: mol_type = other DNA
tttttcttgagtccaacccgctgaggccgcagggcgccttatccggtaactatcgtttttt

SEQ ID NO: 1382 - DNA, 30 bp, synthetic construct
  misc_feature 1..30: note = nucleic acid sequence
  source 1..30: mol_type = other DNA
tttttagttttttggtgctattgtcttttt

SEQ ID NO: 1383 - DNA, 28 bp, synthetic construct
  misc_feature 1..28: note = nucleic acid sequence
  source 1..28: mol_type = other DNA
tttttcgccactggcgaccctgcttttt

SEQ ID NO: 1384 - DNA, 41 bp, synthetic construct
  misc_feature 1..41: note = nucleic acid sequence
  source 1..41: mol_type = other DNA
tttttgcaaaaacaggaaggcagcgtttctgggtgattttt

SEQ ID NO: 1385 - DNA, 41 bp, synthetic construct
  misc_feature 1..41: note = nucleic acid sequence
  source 1..41: mol_type = other DNA
ttttttagcagagcgagtcagtaagacacgacttatttttt

SEQ ID NO: 1386 - DNA, 46 bp, synthetic construct
  misc_feature 1..46: note = nucleic acid sequence
  source 1..46: mol_type = other DNA
ccaagtcattcttgtataccgcgcaggtgcacgaaccccccttttt

SEQ ID NO: 1387 - DNA, 41 bp, synthetic construct
  misc_feature 1..41: note = nucleic acid sequence
  source 1..41: mol_type = other DNA
tttttttcattcagctcccgatgagttccgccgtggttttt

SEQ ID NO: 1388 - DNA, 40 bp, synthetic construct
  misc_feature 1..40: note = nucleic acid sequence
  source 1..40: mol_type = other DNA
tttttgttcttgaagtggtgaggcggtgctacagattttt

SEQ ID NO: 1389 - DNA, 42 bp, synthetic construct
  misc_feature 1..42: note = nucleic acid sequence
  source 1..42: mol_type = other DNA
tgacccaccgatgcccttcagtcggtgtaggtcgttcttttt

SEQ ID NO: 1390 - DNA, 32 bp, synthetic construct
  misc_feature 1..32: note = nucleic acid sequence
  source 1..32: mol_type = other DNA
ttttttatcaaaaaggtttggtatggcttttt

SEQ ID NO: 1391 - DNA, 28 bp, synthetic construct
  misc_feature 1..28: note = nucleic acid sequence
  source 1..28: mol_type = other DNA
tttttacactagaagtttctcccttttt

SEQ ID NO: 1392 - DNA, 41 bp, synthetic construct
  misc_feature 1..41: note = nucleic acid sequence
  source 1..41: mol_type = other DNA
tgcgctcaataggtgcctatttctcatagctcacgcttttt

SEQ ID NO: 1393 - DNA, 39 bp, synthetic construct
  misc_feature 1..39: note = nucleic acid sequence
  source 1..39: mol_type = other DNA
ttaactacctaattaagggtgagcaaaaggcaggcgttt

SEQ ID NO: 1394 - DNA, 32 bp, synthetic construct
  misc_feature 1..32: note = nucleic acid sequence
  source 1..32: mol_type = other DNA
gcgtttttagggggcgtacttggcaaggtcat

SEQ ID NO: 1395 - DNA, 31 bp, synthetic construct
  misc_feature 1..31: note = nucleic acid sequence
  source 1..31: mol_type = other DNA
ggcggagtaaaaggatctcaagacaaaatcc

SEQ ID NO: 1396 - DNA, 31 bp, synthetic construct
  misc_feature 1..31: note = nucleic acid sequence
  source 1..31: mol_type = other DNA
ccatttgcgtcaatggtgaacttagtggtcc

SEQ ID NO: 1397 - DNA, 30 bp, synthetic construct
  misc_feature 1..30: note = nucleic acid sequence
  source 1..30: mol_type = other DNA
tatagacctcccaccatcgcccaaaccagc

SEQ ID NO: 1398 - DNA, 30 bp, synthetic construct
  misc_feature 1..30: note = nucleic acid sequence
  source 1..30: mol_type = other DNA
atctgacggttcactcttgtggcacgctca

SEQ ID NO: 1399 - DNA, 30 bp, synthetic construct
  misc_feature 1..30: note = nucleic acid sequence
  source 1..30: mol_type = other DNA
tgcccagtgcctcacaccaggatgccccag

SEQ ID NO: 1400 - DNA, 31 bp, synthetic construct
  misc_feature 1..31: note = nucleic acid sequence
  source 1..31: mol_type = other DNA
ttaaacctgtcttgtcctcgcccataactac

SEQ ID NO: 1401 - DNA, 32 bp, synthetic construct
  misc_feature 1..32: note = nucleic acid sequence
  source 1..32: mol_type = other DNA
gtctcgacaagcccaggacacctgatccatag

SEQ ID NO: 1402 - DNA, 32 bp, synthetic construct
  misc_feature 1..32: note = nucleic acid sequence
  source 1..32: mol_type = other DNA
acgccgtagcttgccgtaggtggcgtacacgc

SEQ ID NO: 1403 - DNA, 31 bp, synthetic construct
  misc_feature 1..31: note = nucleic acid sequence
  source 1..31: mol_type = other DNA
catgtggtgccggacacgctgaaaaaccagc

SEQ ID NO: 1404 - DNA, 31 bp, synthetic construct
  misc_feature 1..31: note = nucleic acid sequence
  source 1..31: mol_type = other DNA
gcatggcgtcgccgtccagctcggaccaact

SEQ ID NO: 1405 - DNA, 39 bp, synthetic construct
  misc_feature 1..39: note = nucleic acid sequence
  source 1..39: mol_type = other DNA
aagatggtccccggtgaacagctaaccttgaaaattaaa

SEQ ID NO: 1406 - DNA, 29 bp, synthetic construct
  misc_feature 1..29: note = nucleic acid sequence
  source 1..29: mol_type = other DNA
cgggtctcatggcggccgcctgtttctat

SEQ ID NO: 1407 - DNA, 30 bp, synthetic construct
  misc_feature 1..30: note = nucleic acid sequence
  source 1..30: mol_type = other DNA
cagggtgaaaggcaaagtggatggcaagag

SEQ ID NO: 1408 - DNA, 31 bp, synthetic construct
  misc_feature 1..31: note = nucleic acid sequence
  source 1..31: mol_type = other DNA
agcacgggttgctcagggcggactgtcccgg

SEQ ID NO: 1409 - DNA, 31 bp, synthetic construct
  misc_feature 1..31: note = nucleic acid sequence
  source 1..31: mol_type = other DNA
gctggtagaccatgtgatcgcgcatgcccca

SEQ ID NO: 1410 - DNA, 30 bp, synthetic construct
  misc_feature 1..30: note = nucleic acid sequence
  source 1..30: mol_type = other DNA
gtcctcggatcccggcggcggtacacagtg

SEQ ID NO: 1411 - DNA, 31 bp, synthetic construct
  misc_feature 1..31: note = nucleic acid sequence
  source 1..31: mol_type = other DNA
caccttgaattacttgtacagctaacgggcc

SEQ ID NO: 1412 - DNA, 31 bp, synthetic construct
  misc_feature 1..31: note = nucleic acid sequence
  source 1..31: mol_type = other DNA
atgatatatgtaatccagaggttaaccagga

SEQ ID NO: 1413 - DNA, 31 bp, synthetic construct
  misc_feature 1..31: note = nucleic acid sequence
  source 1..31: mol_type = other DNA
actccagcttaagaataccagtcaagccata

SEQ ID NO: 1414 - DNA, 54 bp, synthetic construct
  misc_feature 1..54: note = nucleic acid sequence
  source 1..54: mol_type = other DNA
ggggtctgccgtcgccgatgggggtgttctagcactgctttgcgcacagccgga

SEQ ID NO: 1415 - DNA, 55 bp, synthetic construct
  misc_feature 1..55: note = nucleic acid sequence
  source 1..55: mol_type = other DNA
ccagcaggtggtcggcgagctgcacgctgcctgctgcttatcgtggtccggctcc

SEQ ID NO: 1416 - DNA, 54 bp, synthetic construct
  misc_feature 1..54: note = nucleic acid sequence
  source 1..54: mol_type = other DNA
ccgagagtatgttgtggcggatcttgaagttccttcggcttcattctgctgcaa

SEQ ID NO: 1417 - DNA, 53 bp, synthetic construct
  misc_feature 1..53: note = nucleic acid sequence
  source 1..53: mol_type = other DNA
ccaagctttgccgttcttctgcttgtcggcccttgaaggcgagttagatacgg

SEQ ID NO: 1418 - DNA, 53 bp, synthetic construct
  misc_feature 1..53: note = nucleic acid sequence
  source 1..53: mol_type = other DNA
acaaatttgacgttgtggctgttgtagttgtcctcggcgaaagcggttgcctg

SEQ ID NO: 1419 - DNA, 31 bp, synthetic construct
  misc_feature 1..31: note = nucleic acid sequence
  source 1..31: mol_type = other DNA
gggttgcgtcagcaacacgaactctacaggc

SEQ ID NO: 1420 - DNA, 31 bp, synthetic construct
  misc_feature 1..31: note = nucleic acid sequence
  source 1..31: mol_type = other DNA
gccacgttgcctgaccgtccatgtggtatgg

SEQ ID NO: 1421 - DNA, 31 bp, synthetic construct
  misc_feature 1..31: note = nucleic acid sequence
  source 1..31: mol_type = other DNA
tcataaagagacagcgattggatcgatcaag

SEQ ID NO: 1422 - DNA, 32 bp, synthetic construct
  misc_feature 1..32: note = nucleic acid sequence
  source 1..32: mol_type = other DNA
aaggaggagaaaatgaaatctttctgtgcaaa

SEQ ID NO: 1423 - DNA, 38 bp, synthetic construct
  misc_feature 1..38: note = nucleic acid sequence
  source 1..38: mol_type = other DNA
gcggcgattgacaggtggtggcattctcgttttaatag

SEQ ID NO: 1424 - DNA, 39 bp, synthetic construct
  misc_feature 1..39: note = nucleic acid sequence
  source 1..39: mol_type = other DNA
gagggccgcaatagcatgatacaaaaaggagtccgatcg

SEQ ID NO: 1425 - DNA, 30 bp, synthetic construct
  misc_feature 1..30: note = nucleic acid sequence
  source 1..30: mol_type = other DNA
tcccaatcagtgcgaaaactctctatccgc

SEQ ID NO: 1426 - DNA, 31 bp, synthetic construct
  misc_feature 1..31: note = nucleic acid sequence
  source 1..31: mol_type = other DNA
tccttatcatgcgatgcaatttcccgagccc

SEQ ID NO: 1427 - DNA, 30 bp, synthetic construct
  misc_feature 1..30: note = nucleic acid sequence
  source 1..30: mol_type = other DNA
acttatcaggacagtgggagtgacaacacc

SEQ ID NO: 1428 - DNA, 29 bp, synthetic construct
  misc_feature 1..29: note = nucleic acid sequence
  source 1..29: mol_type = other DNA
cttaatgaggaaggcacggggggcagcca

SEQ ID NO: 1429 - DNA, 30 bp, synthetic construct
  misc_feature 1..30: note = nucleic acid sequence
  source 1..30: mol_type = other DNA
ggaagggaagaaagcgagcttgactcatga

SEQ ID NO: 1430 - DNA, 47 bp, synthetic construct
  misc_feature 1..47: note = nucleic acid sequence
  source 1..47: mol_type = other DNA
agtttggaacaagagtctcgagtttgagatctttaaaagttcgccag

SEQ ID NO: 1431 - DNA, 45 bp, synthetic construct
  misc_feature 1..45: note = nucleic acid sequence
  source 1..45: mol_type = other DNA
gtggactccaacgtcaaggaagacacccaatacgggatgccattg

SEQ ID NO: 1432 - DNA, 46 bp, synthetic construct
  misc_feature 1..46: note = nucleic acid sequence
  source 1..46: mol_type = other DNA
tctatcagggcgatgggccatgctcaccagccggcgacccgtcgtt

SEQ ID NO: 1433 - DNA, 46 bp, synthetic construct
  misc_feature 1..46: note = nucleic acid sequence
  source 1..46: mol_type = other DNA
atcaccctaatcaagccgccgcgaaggcaaatcaaccagttcccaa

SEQ ID NO: 1434 - DNA, 46 bp, synthetic construct
  misc_feature 1..46: note = nucleic acid sequence
  source 1..46: mol_type = other DNA
tgccgtaaagcactagtagcggtgcgacacgcgtaagaccccatgt

SEQ ID NO: 1435 - DNA, 39 bp, synthetic construct
  misc_feature 1..39: note = nucleic acid sequence
  source 1..39: mol_type = other DNA
ggagcccccgatttagaaaggagtcctttttcactgcat

SEQ ID NO: 1436 - DNA, 38 bp, synthetic construct
  misc_feature 1..38: note = nucleic acid sequence
  source 1..38: mol_type = other DNA
tcaaaagaggctatgaactaatgaccccgtatctcagt

SEQ ID NO: 1437 - DNA, 45 bp, synthetic construct
  misc_feature 1..45: note = nucleic acid sequence
  source 1..45: mol_type = other DNA
aaatcggagatccttgcgcagacagggtcaggtcagggtggtcac

SEQ ID NO: 1438 - DNA, 39 bp, synthetic construct
  misc_feature 1..39: note = nucleic acid sequence
  source 1..39: mol_type = other DNA
ataggccgctattaataactagctagcttaatggcgctt

SEQ ID NO: 1439 - DNA, 40 bp, synthetic construct
  misc_feature 1..40: note = nucleic acid sequence
  source 1..40: mol_type = other DNA
atttttgtttccgatcttcctagagcatggcttacctgtc

SEQ ID NO: 1440 - DNA, 39 bp, synthetic construct
  misc_feature 1..39: note = nucleic acid sequence
  source 1..39: mol_type = other DNA
agcgttaataagtagcatggcgggttaatcactctcctg

SEQ ID NO: 1441 - DNA, 47 bp, synthetic construct
  misc_feature 1..47: note = nucleic acid sequence
  source 1..47: mol_type = other DNA
cgaaaagtcacctagaccatctggggcaccagcgctcctggacgtag

SEQ ID NO: 1442 - DNA, 38 bp, synthetic construct
  misc_feature 1..38: note = nucleic acid sequence
  source 1..38: mol_type = other DNA
agaaaaaggccaggatgtactgccaagtgggtagatgt

SEQ ID NO: 1443 - DNA, 62 bp, synthetic construct
  misc_feature 1..62: note = nucleic acid sequence
  source 1..62: mol_type = other DNA
aaggatctcttataaattgttcctcggtgtaggtcgttcgctcctgccatatatgatagacc

SEQ ID NO: 1444 - DNA, 32 bp, synthetic construct
  misc_feature 1..32: note = nucleic acid sequence
  source 1..32: mol_type = other DNA
taccgctgccccagcacccccagaatagaatg

SEQ ID NO: 1445 - DNA, 61 bp, synthetic construct
  misc_feature 1..61: note = nucleic acid sequence
  source 1..61: mol_type = other DNA
cagttcgagggccgatgatctttctaccgctcccattgacgtcaatggggtggagacttgg

SEQ ID NO: 1446 - DNA, 54 bp, synthetic construct
  misc_feature 1..54: note = nucleic acid sequence
  source 1..54: mol_type = other DNA
atgtaacctttaaccaaaagaactctcatagctcacgctgtaggtaattgatta

SEQ ID NO: 1447 - DNA, 62 bp, synthetic construct
  misc_feature 1..62: note = nucleic acid sequence
  source 1..62: mol_type = other DNA
ctgatcttagatttatgaacgaatctgcttaaaatccccgtgagtcaaaccgctatccacgc

SEQ ID NO: 1448 - DNA, 62 bp, synthetic construct
  misc_feature 1..62: note = nucleic acid sequence
  source 1..62: mol_type = other DNA
cagcatctcgcgttaaaaaaaccgcgcctttctcccttcgggaagcggggcgaataaatcag

SEQ ID NO: 1449 - DNA, 61 bp, synthetic construct
  misc_feature 1..61: note = nucleic acid sequence
  source 1..61: mol_type = other DNA
gtttctggtgataccgatgagattctgcaggccattgatgtactgccaaaaccgcatcacc

SEQ ID NO: 1450 - DNA, 61 bp, synthetic construct
  misc_feature 1..61: note = nucleic acid sequence
  source 1..61: mol_type = other DNA
gtgagcaaaattgtacgtgaaccttccgaccctgccgcttaccggaacgtagatattttgt

SEQ ID NO: 1451 - DNA, 56 bp, synthetic construct
  misc_feature 1..56: note = nucleic acid sequence
  source 1..56: mol_type = other DNA
atgccgcagagggcttatcctttttacttaccatggtaatagcgatgactaatacg

SEQ ID NO: 1452 - DNA, 46 bp, synthetic construct
  misc_feature 1..46: note = nucleic acid sequence
  source 1..46: mol_type = other DNA
aaaaagggccgcgcaggtcgaggccccctggaagctccctcgtgcg

SEQ ID NO: 1453 - DNA, 62 bp, synthetic construct
  misc_feature 1..62: note = nucleic acid sequence
  source 1..62: mol_type = other DNA
gaaatgttactccccgcaatctaatggtctccactgccaagtaggaaagtcccatatatgat

SEQ ID NO: 1454 - DNA, 62 bp, synthetic construct
  misc_feature 1..62: note = nucleic acid sequence
  source 1..62: mol_type = other DNA
gaatactatgtatttccctaaagcccgacaggactataaagatacccagcaaaataaacaaa

SEQ ID NO: 1455 - DNA, 38 bp, synthetic construct
  misc_feature 1..38: note = nucleic acid sequence
  source 1..38: mol_type = other DNA
attggaacaccccactgcctgctattgtctgttgagtg

SEQ ID NO: 1456 - DNA, 39 bp, synthetic construct
  misc_feature 1..39: note = nucleic acid sequence
  source 1..39: mol_type = other DNA
gccacatctcagacagggaattcgcccttaaccactatt

SEQ ID NO: 1457 - DNA, 39 bp, synthetic construct
  misc_feature 1..39: note = nucleic acid sequence
  source 1..39: mol_type = other DNA
cttgcccgattaggaatacgtagccatgctctaagggcg

SEQ ID NO: 1458 - DNA, 39 bp, synthetic construct
  misc_feature 1..39: note = nucleic acid sequence
  source 1..39: mol_type = other DNA
tgagaatacagggtcattaattaaggcaatgccccacta

SEQ ID NO: 1459 - DNA, 47 bp, synthetic construct
  misc_feature 1..47: note = nucleic acid sequence
  source 1..47: mol_type = other DNA
tgtgactgacaacagagcgtaaccaccacacttttttggcatttccc

SEQ ID NO: 1460 - DNA, 38 bp, synthetic construct
  misc_feature 1..38: note = nucleic acid sequence
  source 1..38: mol_type = other DNA
ttactgtctcgaggcagggcgctggcaagtaatcggaa

SEQ ID NO: 1461 - DNA, 54 bp, synthetic construct
  misc_feature 1..54: note = nucleic acid sequence
  source 1..54: mol_type = other DNA
gtaagtagtgctcatcaaaggagcgagttccgccgtggcaatagggacctgccc

SEQ ID NO: 1462 - DNA, 62 bp, synthetic construct
  misc_feature 1..62: note = nucleic acid sequence
  source 1..62: mol_type = other DNA
acgttgttaataccgcaccagtggctgtccagcagcgggcaaggcagacacctaagcagaac

SEQ ID NO: 1463 - DNA, 62 bp, synthetic construct
  misc_feature 1..62: note = nucleic acid sequence
  source 1..62: mol_type = other DNA
gtcacgctgagttgctcacaccacacggaattgtcagtgcccaacagctcattttgcgtcaa

SEQ ID NO: 1464 - DNA, 61 bp, synthetic construct
  misc_feature 1..61: note = nucleic acid sequence
  source 1..61: mol_type = other DNA
agctccgagtcattcacaactccaggaaaggacgatgatttccccggcaccttcgtgtatg

SEQ ID NO: 1465 - DNA, 62 bp, synthetic construct
  misc_feature 1..62: note = nucleic acid sequence
  source 1..62: mol_type = other DNA
catgatctgcttttctttatacgaatccaggtggcaacacaggcgaaggggcaagtgagtac

SEQ ID NO: 1466 - DNA, 61 bp, synthetic construct
  misc_feature 1..61: note = nucleic acid sequence
  source 1..61: mol_type = other DNA
ttagctccaattctccgggaagaagggacgtagcagaaggacgtcaggcacagatgccatc

SEQ ID NO: 1467 - DNA, 39 bp, synthetic construct
  misc_feature 1..39: note = nucleic acid sequence
  source 1..39: mol_type = other DNA
ttcggtcccaacatagttgtgccccaggatgttgccgtc

SEQ ID NO: 1468 - DNA, 40 bp, synthetic construct
  misc_feature 1..40: note = nucleic acid sequence
  source 1..40: mol_type = other DNA
agattacgctccatccgcagcagcttgccggtggtgcaga

SEQ ID NO: 1469 - DNA, 46 bp, synthetic construct
  misc_feature 1..46: note = nucleic acid sequence
  source 1..46: mol_type = other DNA
cgcagaaatgttacgaagtcccgttgattttggtgccaaaacaaac

SEQ ID NO: 1470 - DNA, 30 bp, synthetic construct
  misc_feature 1..30: note = nucleic acid sequence
  source 1..30: mol_type = other DNA
tctacggggtctgacctcatttcactcgtg

SEQ ID NO: 1471 - DNA, 38 bp, synthetic construct
  misc_feature 1..38: note = nucleic acid sequence
  source 1..38: mol_type = other DNA
gctcagtgcagcaattcgccctccggggtagcggctga

SEQ ID NO: 1472 - DNA, 31 bp, synthetic construct
  misc_feature 1..31: note = nucleic acid sequence
  source 1..31: mol_type = other DNA
aactcacgttaagggataaaatttttacttt

SEQ ID NO: 1473 - DNA, 39 bp, synthetic construct
  misc_feature 1..39: note = nucleic acid sequence
  source 1..39: mol_type = other DNA
ttttggtccgtgaccccgtttacggacttgaagaagtcg

SEQ ID NO: 1474 - DNA, 31 bp, synthetic construct
  misc_feature 1..31: note = nucleic acid sequence
  source 1..31: mol_type = other DNA
tatcaaaaaggatcttgccacctaaaacagg

SEQ ID NO: 1475 - DNA, 53 bp, synthetic construct
  misc_feature 1..53: note = nucleic acid sequence
  source 1..53: mol_type = other DNA
aatgaagttaggggttaataaggcacgctgctggctggcaactagaccgcgca

SEQ ID NO: 1476 - DNA, 39 bp, synthetic construct
  misc_feature 1..39: note = nucleic acid sequence
  source 1..39: mol_type = other DNA
tttaaattcgtgtagttgctcactgtagttgccgtcgtc

SEQ ID NO: 1477 - DNA, 39 bp, synthetic construct
  misc_feature 1..39: note = nucleic acid sequence
  source 1..39: mol_type = other DNA
agtatataacacttgaaccgtaaaaaggccgtggcgaaa

SEQ ID NO: 1478 - DNA, 47 bp, synthetic construct
  misc_feature 1..47: note = nucleic acid sequence
  source 1..47: mol_type = other DNA
tgagtaaatatttgacatactctcgggcgctagatctcgaagacgcg

SEQ ID NO: 1479 - DNA, 39 bp, synthetic construct
  misc_feature 1..39: note = nucleic acid sequence
  source 1..39: mol_type = other DNA
acttggtctttcgttctggagagtcgccctcgaacttca

SEQ ID NO: 1480 - DNA, 154 bp, synthetic construct
  misc_feature 1..154: note = nucleic acid sequence
  source 1..154: mol_type = other DNA
cagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactc

SEQ ID NO: 1481 - DNA, 32 bp, synthetic construct
  misc_feature 1..32: note = nucleic acid sequence
  source 1..32: mol_type = other DNA
tttttacgagcatcacagccggcgaacttttt

SEQ ID NO: 1482 - DNA, 43 bp, synthetic construct
  misc_feature 1..43: note = nucleic acid sequence
  source 1..43: mol_type = other DNA
tttttagcccgaccgctgcgcacgaaccgctctgcgagatagg

SEQ ID NO: 1483 - DNA, 33 bp, synthetic construct
  misc_feature 1..33: note = nucleic acid sequence
  source 1..33: mol_type = other DNA
tttttttaccgtcattgattaatcagtgttttt

SEQ ID NO: 1484 - DNA, 52 bp, synthetic construct
  misc_feature 1..52: note = nucleic acid sequence
  source 1..52: mol_type = other DNA
ttttttcgtcttgagtccaacttatccaagcagctgaagccagttacttttt

SEQ ID NO: 1485 - DNA, 34 bp, synthetic construct
  misc_feature 1..34: note = nucleic acid sequence
  source 1..34: mol_type = other DNA
cccttggaacattggtaagacacgacttattttt

SEQ ID NO: 1486 - DNA, 41 bp, synthetic construct
  misc_feature 1..41: note = nucleic acid sequence
  source 1..41: mol_type = other DNA
tttttggtgcctatcagaaactcagtaagaccaatattttt

SEQ ID NO: 1487 - DNA, 41 bp, synthetic construct
  misc_feature 1..41: note = nucleic acid sequence
  source 1..41: mol_type = other DNA
ttttttcgccactggcaagtgctggtagcggtggttttttt

SEQ ID NO: 1488 - DNA, 40 bp, synthetic construct
  misc_feature 1..40: note = nucleic acid sequence
  source 1..40: mol_type = other DNA
cggttcacttgtcagtcagcgatttgaagcatttattttt

SEQ ID NO: 1489 - DNA, 41 bp, synthetic construct
  misc_feature 1..41: note = nucleic acid sequence
  source 1..41: mol_type = other DNA
tttttcccttcagctcgatgctccttgaagtcgatgttttt

SEQ ID NO: 1490 - DNA, 65 bp, synthetic construct
  misc_feature 1..65: note = nucleic acid sequence
  source 1..65: mol_type = other DNA
tttttttagcagagcgaggtatgtagtggttgtcgggcagcgagggtggaagctagatgcaactt

SEQ ID NO: 1491 - DNA, 43 bp, synthetic construct
  misc_feature 1..43: note = nucleic acid sequence
  source 1..43: mol_type = other DNA
tttttgtatccacatagcgtaaggcattctcatggtcgcagag

SEQ ID NO: 1492 - DNA, 38 bp, synthetic construct
  misc_feature 1..38: note = nucleic acid sequence
  source 1..38: mol_type = other DNA
tttttagttcttgaagtggtggaaagcgaaagggtgct

SEQ ID NO: 1493 - DNA, 55 bp, synthetic construct
  misc_feature 1..55: note = nucleic acid sequence
  source 1..55: mol_type = other DNA
tttttccgcgggaaggaaggtccgctggattgaagaggctatggcagcaatatta

SEQ ID NO: 1494 - DNA, 42 bp, synthetic construct
  misc_feature 1..42: note = nucleic acid sequence
  source 1..42: mol_type = other DNA
tttttctacaccccttgctgtgggggcctaactacggttttt

SEQ ID NO: 1495 - DNA, 32 bp, synthetic construct
  misc_feature 1..32: note = nucleic acid sequence
  source 1..32: mol_type = other DNA
tttttgtggcgagaaaccggcagcaggttttt

SEQ ID NO: 1496 - DNA, 29 bp, synthetic construct
  misc_feature 1..29: note = nucleic acid sequence
  source 1..29: mol_type = other DNA
tttttttggtatctgcccccgttcttttt

SEQ ID NO: 1497 - DNA, 65 bp, synthetic construct
  misc_feature 1..65: note = nucleic acid sequence
  source 1..65: mol_type = other DNA
ttttttcagggttattgtcggggaaaaaaatcgacgctcaagtcagaggcgttgctggcggatac

SEQ ID NO: 1498 - DNA, 40 bp, synthetic construct
  misc_feature 1..40: note = nucleic acid sequence
  source 1..40: mol_type = other DNA
tttttcttcggaaaaagctcctagaaggacagtatttttt

SEQ ID NO: 1499 - DNA, 48 bp, synthetic construct
  misc_feature 1..48: note = nucleic acid sequence
  source 1..48: mol_type = other DNA
aacgttcttcgggtggttaattgtcaggtaggcggtgctacagttttt

SEQ ID NO: 1500 - DNA, 30 bp, synthetic construct
  misc_feature 1..30: note = nucleic acid sequence
  source 1..30: mol_type = other DNA
tttttgcagtgttatcaaaagcagcttttt

SEQ ID NO: 1501 - DNA, 41 bp, synthetic construct
  misc_feature 1..41: note = nucleic acid sequence
  source 1..41: mol_type = other DNA
tttttaaacaaaccaccctatagctcttgatccggcttttt

SEQ ID NO: 1502 - DNA, 40 bp, synthetic construct
  misc_feature 1..40: note = nucleic acid sequence
  source 1..40: mol_type = other DNA
tgccggggccagggcacgggccactggtaacaggattttt

SEQ ID NO: 1503 - DNA, 56 bp, synthetic construct
  misc_feature 1..56: note = nucleic acid sequence
  source 1..56: mol_type = other DNA
ctgtctatgacagtttcttctctgtactgggcataatgccaggcgggccatttttt

SEQ ID NO: 1504 - DNA, 34 bp, synthetic construct
  misc_feature 1..34: note = nucleic acid sequence
  source 1..34: mol_type = other DNA
tttttaggcacctatcaagtaagttggccttttt

SEQ ID NO: 1505 - DNA, 29 bp, synthetic construct
  misc_feature 1..29: note = nucleic acid sequence
  source 1..29: mol_type = other DNA
ttttttttttgtttgcggtaactattttt

SEQ ID NO: 1506 - DNA, 40 bp, synthetic construct
  misc_feature 1..40: note = nucleic acid sequence
  source 1..40: mol_type = other DNA
accaatgccgtcaatccataggctccgcccccctgttttt

SEQ ID NO: 1507 - DNA, 36 bp, synthetic construct
  misc_feature 1..36: note = nucleic acid sequence
  source 1..36: mol_type = other DNA
aaggaacccctagtgatggagttggccactccctct

---

The invention claimed is:

1. A nucleic acid nanostructure for expression of a target gene in a eukaryotic cell comprising:
   (a) a single-stranded DNA (ssDNA) scaffold strand that comprises an expression cassette comprising at least one nucleic acid sequence encoding the target gene, a promoter, a terminator, and a polyadenylation signal sequence, and
   (b) at least one enhancer staple that comprises a sequence that binds to the ssDNA scaffold strand and upon binding enhances expression of the target gene when the nucleic acid nanostructure is inserted into the eukaryotic cell, as compared to a nucleic acid nanostructure without the enhancer staple,
   wherein the at least one enhancer staple binds to the ssDNA scaffold strand at a start region of the promoter and at the polyadenylation signal sequence; whereby when the at least one enhancer staple binds to both the start region of the promoter and the polyadenylation signal sequence, the single enhancer staple acts as a splint that brings together the start region of the promoter and the polyadenylation signal sequence.

2. The nucleic acid nanostructure according to claim 1, wherein said ssDNA scaffold strand comprises a plurality of nucleic acid sequences encoding a plurality of target genes.

3. The nucleic acid nanostructure according to claim 1, wherein said nucleic acid nanostructure comprises a first subunit and a second subunit that each independently comprise a nucleic acid sequence encoding a first target gene and a second target gene, respectively.

4. The nucleic acid nanostructure according to claim 1, wherein the at least one enhancer staple has a length ranging from about 60 to about 250 nucleic acid bases.

5. The nucleic acid nanostructure according to claim 1, wherein said ssDNA scaffold strand further comprises (a) an inverted terminal repeat nucleic acid that forms a hairpin, wherein the inverted terminal repeat nucleic acid sequence is positioned upstream or downstream of the expression cassette; or (b) an inverted terminal repeat nucleic acid sequence binding site positioned upstream and downstream of the expression cassette.

6. The nucleic acid nanostructure according to claim 5, wherein said ssDNA scaffold strand further comprises said inverted terminal repeat nucleic acid sequence that forms the hairpin, wherein formation of said hairpin results in increased expression of the target gene, as compared to an amount of expression in an otherwise comparable nanostructure that comprises an ssDNA scaffold strand without the inverted terminal repeat nucleic acid sequence that forms the hairpin.

7. The nucleic acid nanostructure according to claim 5, wherein said ssDNA scaffold strand further comprises an intron, a DNA nuclear targeting sequence, a Kozak sequence, or a woodchuck hepatitis virus posttranscriptional regulatory element.

8. The nucleic acid nanostructure according to claim 1, wherein said ssDNA scaffold strand comprises a nuclear targeting sequence.

9. The nucleic acid nanostructure according to claim 8, wherein said ssDNA scaffold strand further comprises an intron, a kozak sequence, or a woodchuck hepatitis virus posttranscriptional regulatory element.

10. The nucleic acid nanostructure of claim 1, wherein the nucleic acid nanostructure comprises a first enhancer staple that binds to the ssDNA scaffold strand at the start region of the promoter and a second enhancer staple that binds to the ssDNA scaffold strand at the polyadenylation signal sequence.

11. A composition comprising the nucleic acid nanostructure according to claim 1.

12. A plasmid encoding the nucleic acid nanostructure according to claim 1.

13. A method of expressing a gene from a nucleic acid nanostructure comprising:

i) providing the nucleic acid nanostructure of claim 1;

ii) delivering said nucleic acid nanostructure provided in step i) to a cell; wherein said delivering comprises transfecting or transforming said cell; and iii) allowing said cell to express said gene.

* * * * *